United States Patent 10,407,724 (METHODS AND COMPOSITIONS FOR SCREENING AND TREATING DEVELOPMENTAL DISORDERS) - sequence listing, part 10

SEQ ID NO: 189 - DNA, 1806374 bp, Homo sapiens
  misc_feature (1018079)..(1118078): n is a, c, g, or t
gtggcttactgcagtttaaactatgagaactcactctaaaaacagatgtaaacagggctaatattctgcttcctgtgttgtgacctctgcttccacatttaggtttcttttggcaccactttccttaggtaatttctctccataaagtcctgtagagagggtatggagttttgctcttgtcgcccaggctggagtgtggtggtgtaatttcggcttactgcaacctccatctcctgggttcaagcgattctcctgcctcagcctcctcagtagctgggattacaggcacctgccaccacgcccagctaatttttctatttttagtacagacaggatttctccatgttggccaggctggtcttaaacttctgacctcaggtgatccacccgcctcagcctcccaaagtgctgggattataggcgtgagccaccttgcccagcctgtaatcttattttttatatatatatatatatatatatatatatatatatatatatatatatatatatatgaaactttattatatatatatatgaaactttatttcatatatatataatctccaactttatttctagtttatcaatatgccgatttttaaattcatcaatatgcccatcatgattctttctgagaaacattgaacatggattcttcttcttaactctctcaagttcctcctccctgtggcccagcactctggccagcatcctcccccaccccgcactgtcttcccctcccctaccttgccctcactggcccagggtgcttgttcatctccccttcttcctcttcaaacctgactccttcttcaagactcagctctagctctatgtagaagatgaagcccctccttgacccttcctcccttcaaattctctacatctctttaatctatgttgtagaatttagcacctaattatattctgacttcaattatttatagttgttacatgcaaatagtggtaaacgatgcctcataccacagtgacctacttgtgcccgccacctgatgctttatccacattaggcacttaattaatgtggactgagtgactggcccatggattgatagcaagcacttagcaaaaccttgacctgatgttttacaagactctttattgtgcattttattcagaccactgaaaatgcagcgaaaggggcacttatgcctgacttcaaaaagattggtagaaatgatgcttttcccaagagcattactcccccttacagcatatctgtttcagtatctgttttgggaatttcaaagtgatttgttatctgtttgtgagatttctatccatccagggcttggcacctaaaatgggcacatctatgaaatatcaaaggaagaataatttcaaaccacatgagatattctcacaagttgggtaaattgcacatccttagggcacttggtcccttagatcggttatttatgttttacataatttatttcaagtacaggtttttagcatatactttcaagcattttggaaatattctttaacagtcactattctagtcaattgattttaagtcagaaaatatgtccttggtccccacgatgctccagctgctgtgctgggagttaggaacagagacttcagcagacgcatggctcctgctctcaggaaattcacacgacgttggagagtcagaagggtctccaagaaaactcagtgcacattgcaactgcttgacagagtgacagcacatgctgtggccattgcggggactctgctatggcagatcagagggtggtgggtggctccatctctgtctgtcggagctgggctttgtggctgatgaaactgttccctattaacaagacgttaaaacaacatttatggaaaatgcatcgtaggtagtaggcgaggtgctttcttatgaaatgtgggttcttgattttgactgaacatcaggggaaactgtcttcagtcaaaaaaaaaaaaaacaccaaaaaaccagacttgtcactgcgttaagacaaagcacttaaaacctcatcatatctgtcctaccatggggacaatgatgaggaagccattggcacaaattcactgcattccttctgggaaagagctcttccacctgctgtgcacctaagcctttgcagtcatgaacgcaagtgcaattgcaggcaggcctccagctcaccatcctaccatccctctgttgtgagctcggatgtgttcttcagccggtcaaggaatcatggcttgaaaagaagggaaactcttagggcatttgggaaccagaggagtaaggtgggggtgaggccagaagggaggagaacagagctatgggcaaaggttggttttcccgtttccttttctagtgtcttcctagtagagtctccacattaagtagtttgttgattttgtgggcccctggtgtgttactggcccacgtcacaggggaagtgagcaaagctgaccagaagggcaaagctccttgaagctctttccaatgggcttccctgcatgtcccatatccctccaaccccagacaccagcaccttctgcttctgtaatccagtagtcaacaaggagaatatctgatgtaaccacttcagagtgaggcctaagcaactctctgtgttaccctcccagggtcaacatggcctatttgtgagagtaacataatattggtgagatgtgtggcagtggaaaccctttaacactgtctacctcatttgcagcttattgtcacatggaggagtatggaatgcagacatgactgtcactattctgtgtatgggtaaactgaggtgctggtggtcacaggccacctataaccctgttggaaacattttcactgtattacagctcattcccacaattcattaaggcacagacaagattatttttgcttttaactgtttttttttttaatttcagcttttactttgcattcagggaggacatgggcagctttgttatatgagtatattgcatgatactgaggtttgtggtacaaatgattctgtcatccaggttgtgaatagtaacatacagtaggcagtttttcagctcttccccccttgctccctctctcttacctttgtggtccacagtgtctatcgctcccatctttatgttcatgtgtacccagtgtttaggtcccacttataagtaagaatatgcagtatctgattttctgcttctgaattaatttgcttaggataacagcctccagctacattcatgttgctgcaaaagacatgattatgtttttttaatggctgtatagtatttcatggcgtatatataccatattttctttatccaatccactattgatgggcatctgtgttgatttcatgtctttgctattatgaatagtactgcgatgaacatatgaaaaggtgctgatgttgacattggcctgtgggaggcacagggaaagccttcggctcacacctcggagtcactatcactaagtagaggctcaaatggaacctgttctcctacggctaatgaagacaactgcccatgtgatgtctcctgtagttcataatgagacgatgtattagtctgtgttcacactgctgataaagacatatccaagactgggaagaaaaagagtttaattggacttacagttcacatggctggggaggcctcagaatcagggcgggaggtgaaaggcacttcttacatggcggcaacaagagaaaaatgaggaagatgtgaaagtagaaagccctgataaaaccattcaatctcatgagacttattaccacaagaacagtatgggggaaactgcccccatgattcaaattatctcccacagggtccctcccacaacatgtgggaattatgggagtaaaattcaagatgagatttgggtggggacacagaaccatatcattctgcccctggcccctccaaatctcatgtcctcatatttcaaaaccaatcatgccttcccagcagtcccccaaagtcttaactcatttcagcattagcccaaaactccacagtccaaagtctcatctgagtaccttttgcctgtgagcttgtaaaatcgaaagcaagctagttactttctacatacaatgcgggtacaggtattgggtaaaaatggctgttccaaatgggagaaattggccaaaacaaagggattacagggcccatgcaagtctgaaatccagtagggtagtcaaattttaaggctccaaaatgatctcctttgactccatgtctcacatccaggttacgctgatgcaagaggtaggttcctatagtcttgggaagctctacccttgtggctttgcagggtatagccccctcccagttgctttcacaggctggcattgagtgtctgtggcttttccagatgcacagtgaaagctgttggtggatctactactctggggtctggaggacagtggccctattctcacagcttcactaggcggtgccccagtagggactctgtgtggagcctccaactccacatttcccttccacactgccccagcagaagttctccatgagggccccaccccagcagcaaacttttgcttgggcatccagacgtttccatacatcttttgaaatctaggtggaggttcccagacctcaattcttgacttctgtgcacctgcaggctcaataccacatgacagctgccaaggtgttaggccttgcaccctctgaaaccatggaccaaaccgtaccttgccccattttagcaatagctggagcagctgggatgcagggcatccagtccctaggctgcacacagcatgggaccctgggctcagcccacaaaaccattttttcctcctaggcttccaagtctgtggtgggaggggttgctgtgaagacctctgtcgtgcccttgagacttttttcccattttcttgggaattaacacttggctccttgtttcttatgcaaatttctgcagccagcttgaatttctcctcaaaaaatgtgtttttcttttctactgcattgtcagcctgcaaaatttctgaacttttatgctctgtttcccttttaaaactgaatacttttaacagcacccaagccacctcttgaatgctttgcttcttagaagtttcttccaccggatgccctaaatcatctctctcaagttcaaagttccacaaatctctagggcaggggcaaaatgctgccagtctctttgctaaaacataacaagagtcacctttgctccagttcccaacaagttccttatctccatctgagaccaccgcagcctggatttcatcatccatatcattatcagcattttggccaaagccattcgacaagtctctagggagttccagactttcccacatgttcctgtcttcttctgagccctccaaactgttccaatctctgcctgttacccagttccaaagttgcttccacatttttgggtatcttttcagcagcaccccactctactggtaccaatttactatattagttcattttcacactgctgataatgacatacccgagactgggaagaaaaagaggtttaattggacttacagttcacatggctggtgaggcctcagaatcatggcaggaggtgaaagacacttcttacatggtggtggcaagagaaaaatgaggaagatgcaaaggtagaaatccctgatgaaaccgtcagctctcatgagacttattcactatcacaaggacagtatgggggaaatggctcccatgattcaattacctcccaccgcatccctcccacaacacatgaaaattatgggtgtacaattgaagatgagatttgggtggggacacagagtcaaaccatatcagaccccttgttgtgcttccaaatatttaataaaataaaacccccccaaaaagaagaagaaaagaaaaggcaagacaaccagactactcagtaggctgctcagagccacatgagagaagatcattttcaaaatcggcttctgcacattttctctttggatccattttcctttcagggaagagcaccctcatagcagagtggccacctttgcttgttaaacacaagagccaggaaatcactttccaacgctaccccctgtttagtgctctgtttagtattaaccagaatcctctgaaaaatcatatgtaatctcagcattcccaagaagtatgtagtttttgttttcttgtttctcttaaattgtgtcatggatgataatattcctgcaaaacttagcaagtgaaataatttccttaataaccttccccctttctatctaaggaacagtatttcttttgttaacaggtttattaaagggcaataatatttggcatttctttcaggactttttcttaagataaaggatttgaaccaagaaaagataatgaccgtgggaaaaccctagtgtgacttcagccccattcaacacaaggcattaaccaagcacctactgtgtggggtgccagatgaaggctaaagtggaggttaacactgagatgtgtgagcctctggtgataggacctggttgtttctgttggctgggaaccaacctctcctgtgagagatagggcagcctcttcacatagtgcatggccaccacaactaaacatttctctcttatttctgcttccaaatttctatcatttaagccattattttccgttaaggtggaaaatacactccttttaagctgaagcaccccaccactaggaggatggctcttttgagatttgcagggtccctctcaggtacccctcaggcttcctcctgcagcccctgcttaccgagggcatctgctgctgaggaaatcagctcccggcacctggtttatgatctaatgtacaagatgcaacagggacgtgggcttctgcgggtatgagtgcaatgaaattcaaacacgacttccaaatctgtttcttgatcctagtgtgtgggtcagctccaggccaggaacaatgaagggagagatgagcaaacaaataaacaacaaaaaccgcccaaaacaaacacacacacaaaacaaatagaaatgaagtccatgtgcaaagacttggcagacacagccattgagccaaaggctattttccccaaagatgaattcttgccttcataaggcaaggaatagcagcaggcatttacataaagcgaataaactggcactgttaagttccaggacacgtcctggggcttagcctcctttcatttattcagcctaattcccaccggtgacagctaccaccatgtttagggctgtgatgccagcatcccaaagggtcactggattttggctttgatgtcccaacacagaagagaagattcaagcactgtcaacaaaaatatttgtctaaagactagatcaatcaaaatgttcacttaaccagaaggtcaacctactcaggcccccatttctatataccacagatgcctttggttttgaacagtagaagtctaacatctccagtaaagcctcattgctaactagaaattatcatgtctcacaggacagcgcaatacagaaaaaatggcattttccattgacataattattgtggtttattttcagggacataaattgtaacgattcaactgataaatttaatacaacttaaaattgcatgtagtcaccatagacggtggcataagcaaggatcattagagaaaatgcaagtctttagccatttcaaactccacactgttttgttgttgttgcttttagtccaaggagcattgctcaaattaaattttaggtgacattattaaaacaagctctctttttgtttgtttgtgcctaaagctttctgtatctgtggccatgaccctatcattgccccagtctcttggaggggttttgggatgttcttaagcataacttaatccactggcttagctttggagaactgtgaaggacctttgagatcatgggttccagaaaggggctgccaaatggcatggccagctctgccacttacaagtagtgggaccttgcaagttacctcacttctccgttcccatcttacaactaacaagacgaagtcacagggttacgtgagatttctcacgaaaggactaggaagcatctcaacgagattaggtgctcaataactttccattattattaaggaggaaagagggataaatatttcaatggcacaaaagctcccaacagcatgggtcattatgtgagatgcagtaaaaacacaacttgatagagagactatcccctctggaaactcctaagtttcaaattctgtaagtttgaaattgtttaaaattagcaatggttacacatgaataataaaatgaatggttacacatgaagtaatttgttaccttcaagttgacatttttaaaattttatgtatacattttaaggtggcagatagatttaaccagatgtttactgcattccttttcacaggatctgtctacaggctaagacaagcaaacatgcttaagtgagacacatgactaagatataagaccactcagaagctctttgcaaggaagcctttaggaccagaaacttgtgtttcaggaatggagatgtgagtcctttgattttgggtgtgctctctgaggtgtgcacacaaatcacagaaggttttgtttttgttagtcacttttgcaagagattataacctatgagtcactggctcattaattaaactttagagcaacccagtgaagttccaaaatgttaacaaaagtcactgacaccaagggtaagatgcttgagctttttcatcttttcttgtcctacacaaaagcatgaacaagatgtcatttaaggatgttaataatcacaactgtgaagagcttgggaagaagactaaccacaggagctcttctaccaggaacccacatcatgcactgggacatcttgtccaccctttgacccagttttcccgtgaaggaaatggacatgatccaggattctaagtggagacacagccccttggagggaatagctacattacaataaggtttctttctttcccaccactcctctgatgtccatttgtctctgtgtagagagaggtccctttaaaacctcactatagagagcttggggagagacggcttctgtttctgtctccaggcaggcctactagcaatgctacatgagcagcagagccctgcacagcacatttcaaccgtgtctagcaccctcactctccttttctgctgtgtttgttctgaatagcatcatcgctatctgacattataaaacgtagctgtttgttcatgttttcatactgtctctttcctcactagaatataagctttgggagagtaggggtgtattgtatttgctaatacctaagatgcttggtgcgcagacacacacaataaatcgttttttaatattgccctcattctttcacttgcagtttgattgtgagccatttgtctatagaataaagggagcccatcctttgctttttgattgtttgtttttgctgaaatcagagcaagtgcattagtctaagcaaaaaggagagcccggggacttggaagagtctgttggggaaagagagaagaggcaaagtggtgatttcctcttttacatatttttctgagtggagaggaatttctcttgaatctcaaggaggctcatacagtggaaagccttcttctgtctatctgggtggtcggccagccagcggggctcagagcagccttggccaaacatttgcaaaataggaaattaatttttgaattctctgaaacatttttcctttgtgagaactgtagcagcaacatattttaatttgcatttgaatatactgctttttaaaaattatatcagttatccttttaatagtaggtatataaatcactataaaacctaccattaaaaaaggaattcaaaattaaaagcaaaatgaatacttagtatagccactctggagaatagtatagtggttcctcaaaaaattataagtagaactgacacataatccagcaattccactgctgtgtatgtatccaaaagaaagggaattagtatattaaagagatatctccactccactgtgtgctgcagcactctttacaacagccaagacatggaatcaacctaagtgttcatcagtgaatgaatggataaacacaatgtggtacatgtacacagtggaatgttatttttttactcagccataaaaacaaatgaaatcttgtcatttgcaacaagaatgaaactggatgacactatgataagtgaaataagccaggcatggaaaagtatgttgcatactctcgttaatatgtgggagataaaaaaaattgaactcatgaagatatagaatggaacgatgactaccagaggctaggaagggtggtgagagagagagagataaagagaagatggttaatgggcacaaaaatatagttagaaaaataagatttaatggttggataactataggtcatcacaataggatgactatcatggtaatttatggtacatttcaaaacaaagagtggaattggaatgctcctaacaaaaataaatgataaacacccttgaagtgatagattcccccagttaccctgatgtgctcttgcacattgtatgcttgtatcaaaatattacatggacccccaaatatatacaaaaattatgtatttatgaataatatttcataagaatataattaataatcactattaatgaaaacatttccaataaaataaaataaaaggtaactcttagtccaaaaaaggtaaatccaagcaaaaaaatgttattcaaatgggtaactatactaaaattatcaaattctggatttgtttgctaccgatatgaaaaggtgttgtattaatacatggaaataatatctgaggtctcctcatgattcttctaaatctcttcctccttttctcaccccaacatttgtttcctttttccattcttccaccttcctctacagaactctgtcctccagaatggttctgtcaatcctagtagagaggttgctgcttggaggggagacgtggctgctctcaaacaagagcgaggccccacctctggtgtgtcggccagcagcctctcacctcagacatcgtgcagaccactcaccacctgcagtccccacaggaacagcataaatcctcaacattattaccagttaacacataaaacagatcccagggagatagaggaagagaaaaataaacattgattcagaatgtcaggagcactggtcagttttaagtggccatgatgcctgtggggagaagcggtaaccctgcagttatcgggcaagaggaaggcctccaggaggccagaggccaaagagcaaatgaaccacccaagaggtgagaagcaccaaccagcttgcctattgaagattataaaggctaactttgggctttatttcttcttgttttggttccttgaggggtgaagttaggttgcttttttgccatctttcttttttgaaaaatatggccaggcgcagtggctcacacctgtaatcctagcactttgggaggccaagacgggtggatcatgaggtcaggaattcaagaccaacctggccaatatgatgagacccctgtctactaaaaaacaaacaaacaaacagacaaaaaacaaaaattagctgggcgtggttgtgcatgcctgtagtcccagctactcaggaggctgaggcagaagaattgcttgaaaccaggaggtggaggttgcagtgagctgagattgcaccactgcactccagcctgggagacagagtaagactccatctcaaaaaacaaacgaacagaaaatatatagggatttacttatgtgaacttccctttattattgcttttgctacatcctataagttttgataagttgtggtttcattttcatttatctcaaaacatttctgatttcccttttgatttcttctttgactcattcattgtttaagaatgtatttttaattcctacatattttttaattttccaattttccttctgtcattgatttatagtttcataccattggaaaaggtacttggtatatattagtctgttttgcactgctacagaggaatatctgaggctgggtaatttgtaaagaaaagagattttttggctcacggttctgcaagctgtataagaagcatgacacatctgcctctggcgagagtctcaggctgcctccactcatggcgaaaggccaagggaagcagcacacgcagagttcatgtagcaagaggatgcaagagggagggaagggggatgtcaggttgtttttaacaatcagctctcacataaactaacagagtgagaactcactcattaccacaggaagggcatcaagtaattcatgaggaatttgccccatgacccaaacacctcccattcggctccacctccaacactgaggctctcatttcaacatgagatttggaagggacaaacatccaaactatatcatggcatggttttaatcttgtttaattttttgagacttgttttgtggcctaacacttgatctaccctggagactgttctgtgtgcactagagaagaatgtgtattctgcggctgttggatggaatgttctgtaaatgtctcttaggtccatttatctatagtcttgttcgagtccactttttgcttatcgattttatgtttgggtgttctacacattattcaaagtgcgctactgaagtctctgatatcgttgtgctgctgtctatttctccagttctgtcaatatttgttttatatatttaggtgctttcgtgttgatatatacatttatgattgttcaatcttcctgatgaattgattcttttatcattatacaatgttgtattagtctgttcccatgctgctaataaagccataactgaaaactgggtagtttataaatgaaataggtttaattgactcacagttcagcattgcagggggaggggcctcaggaaacttgcaatcatggtggaaggggaagcaaacacacccttcttcacatggcgacagggaggagatgtgtagcgcaaagtgggaaaagtcccttatagcaccatcagatcttgtgagaactcactcactatcatgagaacaacatgagagtaactgctcccatgattaaattacctcgcactggggccttcccatgacacatggggattatgggaactacaattcaagatgagatttgggtcacagccaaaccatattattccacccctggcccctcccaagtctcatgtctttacatttcaaaacacaatcatgcttttccaacagtcccccaaagtcttatctcattccagccttaaccgaaaagtccaagtccaaagtcacatctgagacaaggcaagtcccttctgcctatgaccctgtacaatcaaaagcaagttagttatgtcctacatacaatgggggtacaggcattgggtaaatacacctgttccaaatgggataaattagccaaaacaaagaggctacaggcaccatgcaagtatgaaatccaatagggaagttaattaaaacttaaagttccaaaatgatctcctttgatttcatatctcacatgcagatctcgctgatgcaagagttgagcccccatggccttgggcagctccaaccctgtggctttgcagggtataggccctctcctggctgctttcatgggctgatgttgagtgtccctggcttttctagatgcagagtgtaagctgttggtggagctaccattctgggttctggaggaaggtggccctcttctcacagctccactaggtggtgccccagtagggactctgtgtgggggctccgaccccacatttcccttccacactgccctagtaaagttcctccatgagggctccacccctgcatcaaacgtctgccttgacatccaggtgtttacatacatcctctgaaatctggttggaggtttccagtcctcaattcttgacttctgtgaacccacaggcccaacaccttgtgtaagctgccaaggcttggggtttgcattccatgaagcaatggcctgagctgtatgttaaccctttttaaccatggctggaatgaagggcaccaagttctgagactccacaaagcagcaaggccccgggcctggcctatgaaaccaattttccctcctaggcctcctggcctgtgatgggaggggctgctgtgtagacctctgacatgccctggagacattttcccccattgtcttggtgattaacattaggcttctcattacttatgcaaatttctgcagctggctttaatttctccccaggaaatgggtttttcttttctattgcatcatcagactgcaaagttttcaaacttttataatcttcttttgaagttttgtcgcttataaatttcttccaccagataccctaaatcttctctctcaagtcaaaagttccacagatctctagggcaggggcaaaatgccaccagtctctttgctgaaacatagcaagagttacctttattccagttcccaacaagttcctcatctccatctgagaccacctgaacctggacttcattgtccatatcactatcagcactttggtcaaagccatttgacaagtctctaggaagttccacactttcccacatcttgctgtcttttgagccctccaagcctctaggaagttccagactttctcacattttcctgtcttcttctgagcccttcaaattgttccaatttctgcctgctacccagttccaaagtcacttccacattttcaggtacgcttacagcagtgccccactacccagtaccagtttattgtattagtctgttctcacgctgctgtaattaactgcctgagactgggtaacttacaaaggaaagaagtttaattgatcacagttttgtatggttggggaggcctcaggaaatttacaattatggcagaaggggaagcaaacatgttcttcttcacatggcagtaggaagcagaagtgccaagtaatatgatttggctgtgcccccacccaaatctcatcttgaaacttgctcccataatttccacatcatgggaagtaattgaatcatgggggaaggtctttcccatgctgttcttgttatagagaataagtctcatgagatctgatggttttataaaggggagttccccagcacatgttctgttgccagacatcactttgctcttcattcactttctgccatgattgtgaggcctcctctgccatgtggaactgtgagcccattaaacctctttttcattataaattcttcagtctcaggtatgtctttattagcagtgtgagaacaaactaatacagtaaaatggtaccagtagagtggggcgtgctgaaaagatacccagaaatgtggaagtgactttggaactgggtaacaatcagaggttggaacagtttgaagggcttggaagaagacaggaagatctgagaaagtttgaaacttcctaaggacgtgttggatgtctttgacaaaaatgctggtagtgataaggacaataaagtccaggctgaggtggtctcaggtggagatgaggaacttgttaggaactggagtaaaggtgttatagcaaagagactagtggcattttgcgcctgccctagagatttgtggaacattcaccttgagatagatgagttagggcatctggcagaagaaatttctaagcagcaaagcattcaagaggtggcttgtgtgctattagaagcattcagttttatgtattcccaaagatacggtttggaattagaactgatgtttgaaaggaaagcagagagtaaatgtttggaaaatttacagcctgatgaagagatagaaaagaaaaccccattttctgagaagaaatttaagccagctgcagaaatttgcataagtaacaaggagccaaatgttaatcaccaagacaatgaggaagatgtcttcaggacatgtcaaaggtcttcacagcagcctctcccatcacaggcctggaggcctaggagggaaaaatgccctgcatccaaggtgcttcagctccagctgtggctaaaaggggccaaggtacagctcaggccatggcttcagaggatgtaagccccaagccttggcagcttacttggggttttgagcctgtgggggcacagaagtcaagaataaaagtttgggaacttcttcctagatttcagaggatgtatagaaatgtctggatatccagccaaaagtttgttgcagaggcagtgctctcgtgaacctctgctaggacagtgtggaagggaaatgtggggtcagagctcccatacagggtccctgctggattatagcctagtagagctctgagaagagggccagcatcctccagaccccagaaaggtacatccacttacagtttgcaacatgcacctggaaaacccattgacactcaatgccagctaagaaagcaactaggaaggaggctgtgcccttcaaagccacaggggagaatctgcccaaggccataggagcccacctcttgcatcagcatgacctgtatgtaagacatggtgtcaaaggagattattttggagctttaaggttaatgactggcccactggatttcagactttcttggagcctgtagcccttttcttttggacaatttcttccatttggaatgggtatatttacccaatgcctatactcctattgtatctagaaagtaactaacttgcttttgattttacaggatcacaggcagaagggacttgccttgtctcaggtgagagtttggactgttgacttttgagtaaatgctcaaatgagtaaagatgttgggggactgttgggaaggaatgattggttttgaaatgcgaagacatgagacttgggtcgatcaagggcagaatgatatggtttgactatgtccccaccaaatctcatctttaattgtatgtaactctcataattcccacatgttgtgggagggaccaaattggaggtaattgaatcacaggagcaggtcttacccatgctgttcttgtgacagtgactaagtctcatgagatctgatgattttataaaggggggttctcctgcatacactctcttgcctgccagcatatcagatgtgagtttgctcctcattcgtcttccaccatgattgtgaggcctccccagccatgtggaactaactgtgagtccattaaacctctttccattataaattatccagtctcgggtatgtctttattagcagtgtgagaacagactaatatgccgaataaaggggtaaagcctcttataaaatgatcagatctggtgagaactcactatcttgaaaactgcacaggggtaaccaccccctttattcaattacctcccaccaggtccctcccatgacacgtggggattatgggaactacaattcacgatgagatttgggtgaggacacagccaatccatatcaaatgtccatctttgttctacttgttattgagcattttgtgcacttcctacatgttttgggtaaaatactaaaattctgttgtctgttggggttaatatataaatggagtaagtgggttataattctactgatgtcactaactagctttgcaacattgaagaagctacagtgccactttaatgcttagcttgctcatttgtcagagtatttacatggcagcattgccttttttttttttttttttgagatggagtctcgctctgtcacccaggctggagtgcagtggtgcaatctcagctcactgcaagctccacctcctgggttcatgccattctcctgcctcagcctcctgaatagctgggactacaggagcccgccactgtgccaggctaattgtatttttagtagagacagggtttcaccatgttagccaggatggtttcaatctcctgaccttgggatctgccacctcagcctcccaaagtgctgggattacaagcatgaaccatcacacccggcctgcctttttttataattatgatgtgaatttctcctgatctgggtgaagttaggtgaatttacttgttgtagagaaattgaacaaagtctctcccatggtgacatcaaagactatggtgctaacattattatttgaaggacaactttattatatttataaaaatgatacatgctcactataaaacactcaggcaataaaaaaaagtataaagaataaattttctctaatcctcaaaaatagtgttgttatttggtaaatgtcatctcagatatttctcttcacagatatataatagaaggatgaagaggaagagaaagaaatttctaagtatggattcagaccatattatttttaattttaaaagtattacatttaatagcttttaattctatccaagagagaaaatgttacggaagagttgaaattcagattaatatttattcctcctttagaaactagtttctataaatttgctcaaagcctaggaaagattagagaatgagatacctcttatgcactacttagatctttacagcctcacttgtcccctgctgcagccttgcattgtctcacagcaattttataaagatacaacctgctacgctgggcatttcttctcccaatctgggtttccctgtggctttcactatgggaacccacttagcacagagttgactcaaaagtgcagaggagttaacacccaggggaagactttttaactaatgggaaattagagttaaattattcctactttctccacagtctctagcagtatgatcttaagatggaattttcatgcttcttggggtcacattcccataaatcaagcaagcattcacacttagcagtggctcacctgacaactcacctgtacactgcctcctcctaccttgcccactccatttgttgtattccttactccagcttctggaattgtacttcctcaaatagtaatagctcatcagccccacctccatttttatgctctaaaattaattgaattcattctaaataactaattgaattcattctaaaatattggcactagaaatggcactcctaaaatatttagattattaggaaaacagcctgtcaaaatgatgttttggtatttttgagctcattactggcaagaaagatcccagtgctggtggtaagaggaatggtgttctcaatccctatcatccacggaattgcctgtggttaatcggaataaggtacagttggaagatgaggcattggaatgtgtggggattgcaatgtgtagtattaggaaagctaatgtttataaggactgtggagtggtccagcctcattaatgacattggaaacatttcaaaaaataagtagtagggtcagggcatcaaaattctaacttaagacactctgtgaaagccaaagggccttgataacattagtttggaagattttcacctcctgtagttttacgataaactttgtagatgaagttcacaatcacaccgtaaagtgttgggctgcaaaaaagacagaatgcagtccatacaggtcactaattagaaaaatcatgagaaccagaagcctgggagggggacactgaatgatatggtttggctatgtccccacccaaatctcttcttgacttatagcctcataactcccacatattgtgagagggacccagtgggagataattgaatcatggggccagtttcccccatactgttcttgtagtagtaaataaatctcatgaaatctagtggttttataagaagtttcttctatcacttggctttcattctctcttgactgccaccatgtaagacatgcctttcaccttctaccatgattgtgaggccttcccagccacatggaattctgagtcttttaaacctctttttctttatgaattatccagtctcaggtatgtcttgatcagcagtgtgaaaatggactcatacagtaaattggtactggtagagtggggtgctgctgtaaagatacatgaaaatgtgaaggtgactttggaactgggtaacaggcagacgttggaacagtttggagggctcagaagaagacaggaagatgtgggaaagtttggaacttcctgaagacttgttgaatggctttgaccaaaatgctgataatatgcacaatcaaatccaggctgaggtggtctcagatagagatgaggaacttgttggaaactaaagtaaaggtgattcttgccatgtttaagcaaagagactggtggcattttgctccatcctatagatttgtggaactctgaacttgagggagatgatttaaggtatctggcagaagtaaattctaagcaacaaagcattcaagaggtggtttgggtgctgttaaaagaattcagttttaaaagggaaacagagcataacagtttgaaaaatatgacctggcacagtggctcacgcctgtaatcctagcactttgggaggccaaggtgggtggatcatgaggtcaggagttcaagaccagcttggccaatattgtgaaaccccatctctactacaaatataaaaattagccaggtgtggtggcacatgcctatagtcccagctacttggcaggctgaggcaggagaattggttgaacccaggaggtggaggttgcattgagctgagattgcaccactgcactccagcctgggcgacagagcaagactccatctcaaaaaaaaaaaaaaaaagaaaagaaaaaaaaagaaaaagaaaaaagaaaaaaaattggaaaatttgcagcctgatgaagcaatagaaaagaaaaacgcattttcccagaagaaatttaagctggctgcagaaattcacataagtaacagggaaccaaatgttaatgctaagacaatggggaaaatgtctcaagggcatgtcagagatctttgaggcagcccctcccaccacaggcctggaggcctaggaggaaaaaatggtttcatgggctgggtgaaggacttccctgttgtgtgcagcctagggacttggtgccctgcatctcagcctttcagccatggctcaaaggggccaaggtacagctcagcttatagcttcagagggtgcaagccccaagccttggcaggttccatgtggtattgagcctgtgagtacacagaagtcaagaattgccatttgggaatctccacctagatttcagaggatgtatggaaatgcctgaatgtacagggaaaagtttgctgcaggggtgaggctctcatggaaaacttctgctaaggcagtgcagatgggaaatgtggactcgaagccctcatacagagtccccactggggcactgcttagtcgaactgtgagtagaggaccagcatcctccagaccccagaaaggtaatccactgacagcttacaccatgcacctggaaaagccacagacactcaacaccagcccgtgaaagcagctgggagggaggttgtagcctgaagccacaggggcgcagctgcccaagaccatggaaacccaccttttgtatcagtgtaaactggatgtgaaacatggagtcaaagggatcatttttgagctttaagatttgattgcccaactggattttggacttgtatatggcctgtaaccgctttgttttggccaatttcttccatttggaatggctgtatttacctaatgcctgtacccccattttatctaggaagtaactaacttgcttttaattttacaggctcataggaagaagggacttgccttgtctcagatgagactttgactattggcttttgaattaatgctgaaatgagtcagcaggaaaagacgttggaggactgttgggaaggcctgattggttttgaaatgtgaggacatgagatttgggaggggtcatcagtggaattatatggtttggctttgtcctcacccaaatctcatcttgaattatagctctcataactcccatgtgttgtgggagggacctggtagaagatagttgaatgatgagggcagtttccctcatactgttgttgtggtagtgaataagtctcataagatctgatggttttataagaggttttctcctttcacttggatctcattctttcttgcttgccaccatggaagacatgccttttgcctaccaccattattgtgaggcctccccagccaagtagaactgtaagtccattaaacctttctctttataaattacccagtcttgggtatgtctttatcagcagcatgagaacaaactaatacactagataagcctgagattctttaaaccacaaattctttttaaaacgcaaaagttgcactctcctttttgttggagaagggtagcatctccttgcctgaaaaaggcctgaattcacctgaatcaagggcttcacctaagggcacttgatttcactaaagcactggagtctcttaaaggcagaattgatcaaatagaagaaagaattcatgagcgtgaagacaggctatttgaagatacacaatcagaagcaacaaaacaaaaaagaataaaaaagaatgaagtatacccacaagatctagaagatagcctccaaatggcaaattattggccttaaagaaagagttattggccttaaagttattggtttaaaaaaaaaggtattagccttaaagaaaaggtattagccttaaagaaaatgtagagaaagagatagaggtagaaagtttattcaaaggaataataacagagaacttcctaaacctagagaaagataccaatattcaaatacaagaaggttatagaacaccaatccaatttaacccaaaggagactatctcaaggcatttaataatcgaactccaaaaggtcaaagataaagaaaggatcctaaaagcagcaaggaaaatgaacacatagcatacaatggtggtccaatatgtctggcagcagacttctcagtggaaacatttcaggccaggagagagcgacatgactgtttaaggtgttgatggaaaaaacttttaccctagaatagtatattcagcaaaaatgtccttcaagcattaaggagaaatacgtaccttcttggacaaacaaaagctgagggatttcatcaatatcagagcagttctacaagaaatggaaagggagtttttcaagcagaaagaaaaggatgttaatgagtaggagaaatgcaaagggagtttttcaagcagaaaagaaaaggatgttagtgagcaagaagaaatcatctgaaggtacaaaactcactggtaatagtaagcccataggaaaacaaagaatattataatggtgtaattgtaatgcataaactgctcttaagtagaaagactaaataatgaatgaatcaaaaacaataactacaacaaattttcaagacatcgagagtatataatgagacataaatacaagcaacaaagagttaataagtagggggatgtagttaaagtgtagagctgtgattagttttctttttgcatgtatgttgcttatgtaatcagtgttgtcatcagttttaaataatgggttgtttgcaagactcacagtaaccataaattgaaaaacacaaaacagatacacaaaaaattaaaagcaagaaattaaataataacaccagagaaaatcaacttcactaaaagggagataggaatgaaggaaagaaggaagagacaccacaaaacgactaggaaacaaataacaagatggcaggagcaagtctctacttaccaataatagcattgaatgtaaatggactaaacattccagtcaaaaagacagagaatagttgaatggatggaaaaaacaagatccaatggtctcttgcctgcaggaaacacatttcacctataaagataaacatacacttaaaataaaaggatagaaaaaggtgttctatgccaattgaaaccaaaaaaggacagtagtaggtatacttacataagacaaaatagatttctaaacaaaacctgtaagaagagacaaaaaaggttattatataatgataaagggatcaatcctgcaacagaatataacaattataagtatatatgatgaagaaattaagaaggaaattgaaaatttgcttgaaacaaatgataatggaaacacaacataccaaaacatatggaatacggtgaaagcagtagtaaaagggaaatttgtatccataagtgcctgcatcaaaaaggaagaaaaacttcaaataaccccatgatgcatcagaaagaaccaggaaaacaagagcaaaccaaacacaatattagtagaagaaaagaaatcataaagatcagagcaaaaataaataaaattgaaataaaagaaaacaatacaaaagatcaacaaaacaaaaagtttttttaaaaagataaagaaaattgacaaacctttagccagaaaaacaaagaaaaaagggagaaggcccaaataaataaaatcagagatgaaaaaggagacattacaactgataccacagaaattcaaaggatcattatttgtggctactatgagcaactatatgccaataaattggaaagtctaaaggaaatggacaaattcctagacacatacaacctaccaagattgaaccacgaagaaagtcaaaacctgaacagaccaataacaagtcacaagattaaaactgtaataaaaagcctcccagcaacaaaaagcttgggactcgatagcttcactgatgaatttaccaaaaattttaaaaaactaataccaatcctaccaacctattccaaaaaatgaaggaagaaatacttccaaaatcattctatgaagccagtattaccataatactaaaaccaaagacacatcaaaataagaaaatttcaagccaatatctctgatgaatattgatgcaaaaatcctcaacaaaataccagcaaacaaattaaaaaatacattagaaagatcattcatcacgaccaattgggatttatcccagggatgcaaggatagttcaacatacactaatccatcaatgtgatacatcatatcaacagaatgaaggacaaaagccatgtgatccatatgatcaattgaagtgaaaaagaatttgataaaattcaacatctcttcaggataaaaaccatcaaaaaacaggatatagaagaaatataccttaacataagaaaagccatatatggcagacccacagctagtatcatactgaatagagaaaaactgaaatcctctcctctaagatctggaacatgacaaggatgctgtgtcaccacagttattcaacacagtactgcaagtcctagctagagcaatcagacaagagaaaaaataaagggcatccaaattggaaaggaagaagtcaaattatccttgtttgctgatgttataatcttgtatttggaaaaacatcaagactccaccagaaaactattagaactgataaaaaaaattcagtcaagtttcaggatacaaaatcaacacacaaaaattagtagcatttctatatgccaacagtgaacaagaaaccaataaatacaataaccataaataaaattaaatacctaagaattaacttgactaaagaagtgaaaggtctctacaatgaaaactataaaacattgattaaattgaataggacacaaaaaatgaaagatattctatgttcatagattgaaagaatcaatattgttcaaatgtcatactatccaatgcaatctaaagattcgatgcaattcctatcaaaatactaatgactttcttcatgtaaatagaaaaagcaatcctaaaatttatatggaaccacaaaagacccagaaaagccagtcatcctaagcaaacagaaaaaaactgttaactgtttgtctttctgtgcctggcagagtttacttaacagttaatttaattgtacacttgaaaataactaaaagcatataatttgattgtttataacacaaaggaaaaatgcttgaggtgatggataccacatttactctgatgtggtcattatgcattacatgcctatatcaagatatctagtgtatcccagaaatatatacacctactatagtatgtactcacaaaaatttaaaaaatgtccacaatacccaaagtgatctacagattccatgcaatctctatcaaaataccaataacattttttacagaaatagaaaaaaaccataaagttcatatggtatctcaagggacctcaaatagccagtcttacaattttgaaaaactataatacagttggaggtctaacatttctttatttgaaaacaactatgaagcaacagatgtgttgaccaatggaacagaatggagaactcagaaattttgcctttattgccaaatcgttttcaataagggtgccaagactactccatgaggaaaggacagtctcttcaacaaatggtattgggaaaaacggatattcatgtgcaaacggtgaagttttgagtataccatatgcaaaacattaaatggattacagacctaaacataagattaaaaactattaaaatcttggaagaaaaaatagggggaaaacttcaggacattgactttggcaatactttcttggatatgacatgaaatcacaggcaatgaaggcaaaaatagatatactgaaccatatcaaacttatagatgtctgaacatcaaaggaaacaatcaaggaagtgaaaaggcaatctatggagaggaagaaaatatttgaaaaccttctatctgataaaaggttaatatatatatgtccatacatatggaacttctgcagctcagtgacagaaatgcgaataacttgatttaaaagtggacaaaagactcgaatacacgttttcccaaaaaacatatacagtgacccacaagcatatgtaaagatgttcaacatcactaattataagagaaatgcaaatcaaaaccacaatgagatattacttcatactcattagaatggccaccatcaaaagaactgaaaatggtgtttctgaagatatggagacattgcaatccttgtgtacatataatgaaatattatgcagccttaaaaaagagaaaattgtttcacaggatactgcatagatgaacctcaagagcattattctaagcaaaataagtcagtcacaaagggacaaatgctgcaaaagtccactcatatgaaacatctaaagtcatcaaaatcatagacatagaaagtagaaaggggattgtcaaggacgggtggggagtggggaatgagtattcatgagtgtgaagtttcagttttgaaagatgaaaaaattctagataactgtttcacaacatgtgaatatacttaacaccactgaactgcatatttaaaataactacaatggccaatttaatgttgggtgtttattttttacgacaataataaaaaacatataggattctgtaaagtggcatatcctggaggcctttctcttctcttgtagctgtctggataataaataggagttttaattttctccttgcgaattttaaagtgctgctccaaattgcaagttattagggagaattgtaaggatgttggtgattcacctttcctcattactgcttctggggagggcagaatggggatggaacaagatgtggggccacactgagctgtattgggatttttttctttttcttgtctctcttatgtataggactttttttataggtataacatggtacattaggttggatccctttccttgtttgcttattgttatagaaattttttggccgggcgcggtggctcacgcctgtaatcccagcactttgggaggccgagacgggcggatcacgaggtcaggagatcgagaccatcctggctgacacggtgaaaccccgtctctactaaaaatacaaaaattagccgggcatggtggcgcgcgcctgtagtcccagctactcgggaggctgaggcaggagaatggcgtgaacccgggaggcggagcttgcagtgagtcgagatcgcgccactgcgctccagcctgggcggacagagcgaaactccgtctcaaaaaaaaaaaaaaaaaaaaaaaagaaattttttactgggtatttatttatttactagatacttagggaagggaaatgatgtgatccagcttcattctgccattttgactacttcttgtgagcattcttgcatgttatttgatttactaaggaactcattgctgtgacataacttactttatattataaccaatttaatatacattgaacatgtactctgtcccatactctgggcaaagcactgaggctacagagataaataagatacaccgacagttatggtctcaagtttgcacacacctgaacttcttatgttgaaatccaatccccagtataatggtattaggaggtgagacctttgggagataattagatcaggaaggtggagccctaatgaatgggattagtgttcttttaagaagaggccagagagctagttcctcctcttaccactttgagaagtcagaagtctgcaggctggaagagaacacacaccagaacccaactgtgctggcatcttggtctcagacttcctgccttatgtgagaataaatgtccattgtttaagagccagttcaggatcacttgttatgcagtcaagctgactgagacactgactgagtctgtccattctgaaagtggcacagaacagttcagtgtggtgagcacagggaccacatgcaacatccaggcaaggtctgctcaaggtcagcagggagagaagggacgaggactctgttttgaacccaggtttctgggcaggaaggccaggacctgggacccagaggaacatgcgtgtttaacctcgctctgttgcaacagcttgtctctggaaaagattgagtgcaacccacttggagacaagggctcagaaaagtgcactttgtaggtctttctctgtgtgtgactcaaaatagttctttctaaaaaacaggtaataattcctttcaaaatcttaacaacaatgaattagaacagtgataatatcccgtgctgttaggaaaggagaaagggacattctgttcacattactcaaacaactataaattgcttcaatggttttagaaaacaacttgacagaacctattaaagtaaaaatacgcttgcattttgacacagaaaagcacctttggggaatctatcctaccgatataatgccatcagtttataagtctaggtgaataaggttgtttactgaagcattatttatagtgctgacaaaatagagaaacttgtgtatcaactgtcagtacacggaaaatggaatgcatcttagtgcatccatctgtagaatattatgcatcaaggaatgtaataatatagcgttaattgaaaaagacaatttgctgagtgagcaccatgtatgaatggaaaagaagtctttacatttggagtgtgtgtgtggagtgcgtgttctatgtgtctctgtggctatgtgcatttttatgagtatagaaaacagtatggaaggctgtatactaaggtttcaacattgattaccttggagaagggggtagataactagaggaggaggaagaaatcattgtctttgactttgtgattccctgtggtgaattgttgattttgtttgttgcaacaagcaacatgcattacttttgtagtttgaaaggaaaatccaataaggcatgaagaaataaaatacaaatcttaactgtttgtggtcaggggacaaataaggcaggctcagggtttagggaatgccctcacccactgcataactttcaggtcacttcccctggccccttgtgcacatgctcattctgcagcatccagcaggtaccggcagtgtgggtgttcactctgagagcgcccatcagtgtgagagacacttgactgttgcatgtgagttctaggatagtcactctgtcctctgtgaatccatcactcgtgtagagtcctaactctctggaaaggaagcactgaggtaggtaaatggagcacccaggcggggtaatatgttcaatgtcatcacactgtgccttctaagtgacttctgttcctttagcctaaatacagtactccaaaaaacctctgaaacaatttccaggccgggcgcggtggctcacacctgtaatcccagcccttcgggaggccgaggcaggtggatcacctgaggtcaggggttcgagaccagcctggccaagatggtgaaaccccatctctactaaaaatacaaatattagctgggcgtggtggcgctcacctgtagtcccagctactcgggagcctgaggcaggagaattgcttgagcccaggaggcagaggttgcagtgagccaagatcatgccactgcactccagcctgggcgacagggtgagacttcgtctcaaaaaaaaaaaattccattttaagtaatattaatacaactttgcataatcctagataaaatctgtccaggaaaggtttttcccatcaagtgcacagcataaaaacgtggagctgccctagtccatgcggaaaagaatgaactgatgagggaatattccttcattctccatcttatatgacttgctcttggcaactgctatgtttaaattaggcttcatctccaaagctttcatggaaaagactgactattatccctagtaaaaatgtttatctaagaaaactcatgttcatttctaaataagttgaggggatctatcacaaagcccctttaaaaatacaaacacgatgcatggtttgtagctgatgtggaggcttcagtctaaacctgggagtgtaacatggtgaaggaaatgagaaccagtctgatctcttgactttcctgtgcacaaggcttgatgccatttcattctccaagatctctaaaggtgcctgagcagaaatccacaaagaatccttttcaagccttctgttttccacttagcatcagacaggtcaactgtttctttcaggaattgttcgatttatgccatagtctgcccaatatttaaaaaacaatttctcttttacatagtaaaagtgcaatactataggtgattaagtgattggacacccctgcctcctaccataggctgaagatgatgtgggaagaaatgagaatgccacagaattaggggggaaggagggtccaaaagtaaattttacagcagtgcccttttccctgggtggctttgtcacaatgtcactcaggggctccttggtgcccgagtcccaggaggtgtcccctgcccccatgtgttttcattgctctctttcactgcccctttgttactcagtgtcagtttccttttgctttcgagctgcaacagcacattcacacatccttcacctgtcaccaggtgatgaggctgtttcctctgtgcattcttgacgctgaacctcggcctgatgagctggagtaggaggattcaatcctcagggcctggatggttgctgtatgatgctgagtaaattacttaacctctctgggtctcagctgcctcaccttttaaataagaattttgggctgggcatggtggcttacacctataatcccagcactttgggaggctgaggtgggtggatcgcttgagcccaggagtttgaggccagcctgggcaacatgggaaaccctgtctctacaaaaactacaaaaataattagctggatgtgatgacacacacctgaagttcgagctacttggggagcagaggtgagaggatcacttgaaccccgtaggtcaagactgcagtgagccttgatcatgccactgcactccagcctgggtgacaaagagacacctgtctcaaaaaaaaaaatgaattttggaccagatgatttataacactggatgagtgtaaatgcagtttaagcagaatgttctggtgttgttacctcatctccagaaaagtgttatttccatcaggccaaatgagcaatgtagtgagagaagattcactgaagtaagactcaacaataaaactgagtaactcccaagcttgctgctaacagcagggctggagcccaaagtacagttgatgaaagtcaccactaagggtgggttccccgtgagttatcttggggacttggggcacagtggggcacagatgtgcctctggctggggtgcctggacctgtcttagggcaatgtatgtcaaggatttacatcgagaacgtggtgtctgtttaagatgggttctcatgtctgtaggaaatagggggtgtcttttcttattgcaaatcctcaaactggatgaaaaccttcacactagattttaaatccacagacatcccagttctgtagttttgatgcttctctgtgcttccatttccttatttctaagatgggtttgtaattatctgcttcatggcattattagaacaatcaaaattctgtaaagtgtcaattgcagcatctgagaaggcaagtgcttaatacatgatggccatcgagctatccccctatctcaggagaaagggtgtgcctgcagcatgcaggatgcagagggtgtgcccccaggcaggggagacccaggtccagcatataccttgctggctcaggtgccctgagggccgcagctctgttcacgttctccattatgaactcccataggacaccctgttttttccactcacttaagtacttaattaaatacttttttcaagctttttttaacttattcatgtgtgtgagttccgtaggataccatggtcctgccctcatggaatcacggtgctttaagtcgtcaggacattttatagctcatacacagtagccagatccctggatagacacctgaatgacaggagagtggagcccatgtcaggctgctcggggcttcctgtgagggagcatcgctccaggcagagaaatatgggcaggatttcaaagtgtggagaaaaggggaaaatattcctggtgcctggaacagcataaacaacaagacattatggggaactcactgggtacctggagggaaccgctgtgggttgcagttctgaatctgtggttggactccttggtgagaccacaagagagacgtggaaagaattaagagcccagggtctagtgactttcctgccatcttgaattcacatcgcctcatcttgagtcaagaagatgtttttctgatgctgggtggaaaaaacaatggatttgggagtcaggaggcaaccgtgctcctggcactaattagcaagacaaactcactgtctgtttctccttctctcaagtggggataaagcctgcccttcaccctgtacagagtgatcctgaggacagaataagatcagagatgaaaggagcactttgcagaaaagtccaagtgcccacatgcgagagaatattacatattacaatatcctcttctctttgctgtggaatccaggccttttcccaaagtaagaatcgtggatgctcactctcatgaggggtttaggcttaattggaaatcataccatgacattgccttctggaaaattccctggagaatcagccaaagtagcagcaattatccggggaggcagcttggcaagaactgaaccgcgggggttggtgagatttccctaagacatcctgtcacacagacagagtgttactctttcattttgcttttcccactgggaagacctaatttttctctctattgcagcttaaagttttaaagcaaatttgtttgagtttataagccagaaaaatggaagtataacatcaaatcaggacccaggaagccaacccagctgttgattggtcttcagttcaagatggagtcatagctgaggtgacaaattccaggaagatgagtggttggggtcctcactccctgccaacccagaaacacttctgacattgaatgtcacttccttttctgacagcatcactgaaagaaaatgagaaccctgagctagtagctaataaataatagatttgtaaaatagctatatatttatttcaaatgttttgcctttgtctaaagggacctaggagaagataatcttgtgtttttatgcatatgattttgttttaatctaggattttctattcctctgactcatcagaacttattttatcctacatttcttactttgtgacctgtagatatttgtgctagattccttcattctttttccttctgctgtaaggaaacttgtcaatgtggggagctcttttgagaaatcactcctatttaataattgtgtgctatatctgtgtcttctgtccccttttgtaatgaaaataactgccctctgctgccatagatattagccacccagacagcttcaccctcccggcaactcaccttttgccttgatgccaatgaggtcctctctgcccttgtgtctctttggcctgagacaaaagagtaaagtccacaggtaggtaactcccagaaggatctctactgcctaatctctcaggcaacttttttatccccgcctttaaatattttttgttcattttaaaatgatgtatgtatgttgatgggcaacgatttagcaatgctcttaagaaaatggtgcattttccttggataatttttacttgtgatactgaaaagttagcttgattattttaaccacttttttgagagatcactgacataaaaattgtgtatggttatagcgtacaacttaaagtgttgctatctgtatacattatgaaaagactgccaatatcaagttaatttacatatctatcatctctacatagttaacatttgtgtatgtggtggtgtgtgtgtgtacagtgtgtgtgtaatgagaagatttaatttaagatctatgctttatttttttaatcatcctaacaaatttcaagcatatgacagggttccatcaactgttgtcactaaactgtacatgagatcaacagaatgcattcatcttgcatcgctgaaacttagtagcttgatttaaagaagaagaaaaatattgagtgcctggcaaaatctaaaaagcgcctcctgtgtaccaagagccggggcagacactgaacaagactcattcctgctgccgtcactgctgagctcgggggctgctgctctgtttggagctcctgctctgtgtggagccccgtgcggttctttttgtcatctcacctgcaggctcttccctgcactgccaccagctcgatcttgttttctcttcccctttgcgcttttccacagagctctgattcggacctgagtgtactcctctgtgtgcacgtgccgggccctgcgacacacgcctgtgcttctcgcggggtcagtcatggctttggcctccctggcactgctgtggtttgctgagattttagtgatttctgccgattgcctaaactcagccttggacttcattccgaccccatgcaaggctgtgtggataagccgctgtgaaaccgcctggtacaacgtgatgacgagcagagatacattttgcatccccgactcattatttcgctgtcaaaatgttccatttcctctcctcctccctcgattatagttctctgtgagtggtgactgcatggttaatcaccggctcatcaccggtctgtcacaaatcctggcctctgtacttcatgatgcattttgccaagttccttcagggccagatatggcttatttatcagactgcagggatttatgaacattttcagactttggtcagacacctgcccccaagatggggagaaaagaagcaaaacagaagctggaaaagaggcagcagttcttacaccccgaaaggtgcatgtgaacccatcaaggggcaacccaggccctggccagagtgtatcttatctttcagcagaaggaccaggtgggaagtgaatatctgtggaaataagaaaggccaccaggcagatgataagtccaacgaagaacggtttcttgaagacctgctatgtgggtttgtcaatcaatgcatccgagcttttcctcatcctcaagctggttccgcctagaaaataaggctggctgatgtctgcaagattttgtttctttctgaacatttttcaaatttgtattttttcccctttaacaatccaggtattagtagtattaagacatcctacatgctgtgtggcacaccatcaggccaggcgcggtggctcatgcctgtaatcccagcactttgggaggctgaggcgggtggatcactagatcaggaattcgaaaccagtctggccaaaatagtgaagccctatctatactaaaaatagaaaaaaattagcctggtgtggtggtgtgcacctgtaatccctgctactcaggaggctgaggcaggagaatggcgtgaacccaggaggcagaggttgcagtaagtcaagatcacgccattccactccagcccggggactgtgtgagactccatctcaaaaaacaaacaaacaaaaaaacgtcatagtatgtgttttataaatatgtgttgaccaaattggccccattatttagacatggaaactaaatcgtggaaaacttccaccacagggcactttgatgtaaatattcggtgctttgggtcttcagccggttaatgttagtagcagaacgtcctatgtcttcatttgctttggcagtaatagggatgaaatgtcctttcccttcttcctttatgtcccaagccctatctaagcattaaatgaggttaatatatattaatctaatatacggtaggcacattgatgtgtatttaatgtgagtcatgaataaaaaatattttgtccccttcagagatagattaattttaattgattcctccagtggggaagcagcctcttccttcaccagagaagtgatagaaaggaattctgagatccctgatggagtgtaggtgggtgtatccatcaggggtctccagggacagagaagcaagaggatgcacatagatatatatgagacatttattccggaaatttgctcacatcactgtgaaggtcgcgaagccccaggatgtactgtctgtaaactggagatctgaggagctggcggtgtaattcaggtgactctgaaggcctaagaaaccggggaactgatagtgtaatcctcagctgaagtggggaaagtcactggtgtctgtcctggagttcaaaggcctgaaaaccatgagctgtgatgtctggggacaaggaaagatgaatgtcccagctcaaggagaatgagagagctttctcccttattccacctttttgttctgtttgggccctcaatggatcggatggtgcccacctacattggtgagggcagatcttcttcattcagtccattgattcaaatgccaacctcttctggaaacaccctcacagacacccaggaataacattttaccagctatctgggcatcccttagcccactcaagttgacacataaagttaatcatggcagtgggatgttttggcatgacagtaggctggggtgctccttatagcacttctttaagatccaccatagatggtatttgaaatggaagcactttatcagatgtgccctgggttatcccagagaagtgtgaaggtgctgggagaaacacaccatctcttgtcactagccttggccatggcccctcatcctaagcaagaaaaagcaatgcttgttcagagagatttagcacagactctgagggaatcagaggtcatgctggctaagaagggtgttatgtctttagaaaaagggagtgcatttccttgcccttatgaatctacaaagagagaaggtttaaaattttctttgcccaaatgagccttttggacgtgtatagcatgtggcagtcctctccagcatgactctatccatagctgctgacaacactcctagtttttcatgactcttaacctaaaggaggagtggcaggtgtttcacccacaatggttcaaggtcttgataatggctcaagtatcatgggttgagagttgaccaaaaagaccctttcctgggagactgtcttctctcccccaagctgtcctcatatccaggaacttagctgaagatgctgtagagctagggtggtgggtaagccctcgggctttttgctgccgtgagttactcttaaagattctttatttttcttgttctcttaatgtcctaagccaacctacacactctgatgtggcatggtaaagttgtgacttctatgcctccatgcaaaatcttcacctccagggctgaggcttgggcatgtgccttctgagagttccattatgttcaagatcaccatcaaatatatcttggagatcaactgaaccaggcctccttgactttctccagagatcagagcactgattctctaggggagaaggcacttccagatattctacaaaggctttaaaaaaatggaatctagatgagctctactacatgtcctcctccaactaaactttaccatgttaatcaactttcagataaaatgatacacaaaataaatacatagacaaaattaagtttgaatatattttcaagatcaaaataagtggcccaaattaatcattattctcatatttcacagtagaatataatatgagtatcaaaaacagagttgtttagtccagaacatgtaccagaatccaaaggcaatttttaaaattttatgtccatggtcctttccactttattatgattgtccctgaaattagactcattcttagaaacattactgtttatggtgaccaagatgaatgtcaacctgcccctcagcttgtccaagcttgaaacattcttcttcctgactcttggtcctgacctccctttttacagcattttctttagaaaactagtaattataaattatttctctgtccttttgagatgtaaaccattttaaaggcctcttgctagttttataacccaggagctttgttctcaagggcttgggagccatttctttgactgtaatccttaaagaagtcagaacctctatctcccagtccctgtaggaggggagaagcctaactttggtgggcaccttgctcccaattgtgaaattacttcctgctatgaagatacaaaaaagtttacttttcctctggataaagccaattaacaagcacagatggcctctcatcttctcccccatcccagctcttaaaaactctcctgccctttgcttcagcagagttgagttcaaacgcagttctggtctttctcaccaattgcaatagccttgactaaagccttccttgtctgtttaggtttgtctagtgcaatttttgctttgacagtggtgaagtgaaaagaaaaatctaaatggtagttagtatctaaagataaaaaaaaaggatgtcagaaaggagatgaagcaacaaggaaactggaggcctagataacaatgcccatagttcttcccagtattcacactcgactggaatattgcaaggcttgtctttaaggttttgcaagatcctggtactctatattttccaagacaaatattcaaggtggccttgggatttgggggcttttgagcacaatgcctaatacttttttcagggtggcttcttataaactgcaatgttgtatcagtttctgagtcattttaaatattttaacaaatgtcacaatttattgtatctgtgtcttgcagctgcctaaaccaagatacacattctaaggctaagaaactacatcacaaataaaattctaagtaagagtgaaagcaagatagctggaaatgtagggaatcctgctagagctggagagaggagagtctgagataaccatgtgtatttaccatgaccaggtttatgctgggcttggaaatgttaagatattcatgttatcagtagcccacaagactggatggacattccttggggcccatctgcagtgagttaggcctctctaagtcttgtcaggggcccacaagaggcttccacttactgaattagaaagggctatggctttaaccataaagggctttcctttttgccagcttgtctgggccacaggttctagaccgtggcttcaagctcaactggtccattgacctattatttattccacacacactctagcttacttccccgatttttatttaccattgcttgtctcccattctagcaagtcactcaagcaccaaacttgggtgtcatccaacacctctagccagtcagtgaaaaagtcctatatttgcaacaatgtggatggaactggaggacattatgttaagtgaaataagctaggcatagaaggacacatttctcatgttcccgctcgtaggtggaagctaaaaattaaacaacttcaactcaaggagatggtagaatgacggttaccaggttctggcaagggtggtggagaacaaggattacagaggggatggtcaatgagtacaaaaatacagttaaatagaacaaataagatttagtgtttagtagcacaaaagggtggctatagttagcaataatttattatggatttaaaactaactggaagagtagaattggaatgttcctcaagcaaagaaatgataaacacttgtggtgacgaatacccccattaccctgatttgatccttactcactgtatgcctgtatcaaaacaccatatgtacccatatgtacaccatatgtacttagtgacttaaatatttacaactattatgtgcttctagtaatttctttttaaaagttgtgtagatttcagctatgatttttttctaaactatcacttcttctctatcattcctactaaatggtctacttcagatccttgtcatctctggccaagactactgtaattgcctcccattaggtcacttatcttttatttcacagcatgtttttccccacccagccagaagaataatttttcaaatgcaaggccaaccatatcactccccaactataccatccagtgaattcccattgagcacacggtaacatccaagcatcttaaccaggcacaagtgactctttataacttgtcccctctctcatccctctagtgctatccatatctcagtcctaacaatattggtcaatatgagataaatcctaacaatatagaccgtgtgtctgttcctggacacatcatgctgtttcaggttaccaggccttcactcatgccttgtcatcattcccagcctcacaaactactactttacaattgtgaattgcttatagttcctggtaattttaagtctctgtttgggcagtgactcctggactggtgacaagtgatcatcttggatggacaatttcctcttctccatccccagagccgggcttgcccagggttcggaccactcttcagcaatacagcaaggagtaagcttctgtctggtatcatcccacctctctgttccctttcctacctcccatgcaacctgttatctgtggtgctgaggtcttcgtggtacaaatctaagctggcctctcctggacaaggacccttgtttttttcacctataacttcctcctcttacttttcccttagtaaaactcctatgctttttttctggacagtagcaggaaagaaaaccactgactctattctttgtgctttgatactaacaatgaatacactccatgtgttaaacacctcagaggattatatatatattttaaggagagaataattatttaaaaattgctcaaaagagagagtttgagggaagacgagactattatccaggaacccagaaaagtacttttaagtaatatgctagttaaacataggtgcataaaaaattactccagtacgtagtgacttaaaacaacctttattatcctattgtttttatgggtcaggaattagggagaaaattgttggagtggttttgactcagggtctctcatgacatcgtaatcaggatgctggctgcagtcatctaaaggcccacctgggctggaagagctccctctgagttggctcactcacgtggttgtgggtggagtcctgtttcttgcagccttcccttccttgtcacctggatctctaccttgagctgtctcagtgttttcatcacatgactgtagctacccccagaatgagtggcccaaagagcaagaagaatctgcaatgccttttctgacaatgtcacacattgtcacttctgccacgttccgtcaccagaagagagtcaccaagtccaggcttcattcaagtggaagagagtaagtctccagctttggagaaggggattgtcaaggaatttctggacgtattttaaaatgatgaaattatctgtacaacaaacccccatgacatgagtttgcctacataacaaacctacacatgtacccctgaacctaaaataaaagtttaaaaaatgaaaagaaaaatgatcttattcttcctttgcataagacaagagtggcagtctatgggcaaaggatgcttcaggacttctttctatcaagccccttcctcctgttcatagtttgacacagaaattcaagctcccagaagcatgatccccaagagaatccatgatcgtttacttttgtgtacttttaatcgccctttgtaaggaacaaactatttctcctacacaatgctcacttatgcatgaatatgtgaattgtcagcagtggtttctgattgcacttgttatctaaccaggagtacaggactgaaattttgctccaaatagtgtaattctacttgcatttaatcattgacagttgtgatggttaatactgagtgtcaacttgattggaaggaaagatgcaaagtattgcttccgggtgtgtctgtgagggtgttgccaaaggagattaacatttgagtcagtgggctgggaaaggcagacccacccttaatctggtgaccacaatctaatcagctgccagtgcagctagaatataaaacaggcagaaaaacgtgaaaagattaaattggcttagcttcccagcctacatctttctcctgtgctggatgcatcctgccctcgaacatcagacttcaagttcttcagttttgggacttggactggctctcctttctcctcagcttgcagacagcctattgtgggaccttatgatcatgtgagttaatacttaataaactcccctttatatatatctatcctattagttctgtccctctagagactaatataacagcttttactctatgaaaatgtttagtgcttattagtagagaacaaggttcataaatgctagtgtgcaaaagaattttatggagcacttgttagaatggagatgtctgggacctaaccctagttattttcacttaattgaagtagagtaggcccattaatctgaatattaataagcagcaggtaattctaatactggtgatcacagactgcacttagagaaacactaattgtagtgagtgctactggtgccccaccctgatccctttagcaaggcggtgcacccatacaaagttgctggcaatatcaaccatcacagtctcctaggtttccctttatgcagataattctcctggataaacaaggtttacctggcccaggaggctgcatcccccatacctagcagcatggggtcaatgactacgacttaatcagagatgccaaagactggacttctagactgtgcaggaaattaactcttttccaactcatatgtcagggctctgtggttgaccaagctgaagcgagtttccagctaagaccacatgtgactgcttagctactttacccagccctattacacttttcttactccccttttcccgagggtttcctcagtgaatcacatggagaaaaatccttgtctccagccctgcttctaggaaactctatagattaaccacactgggcttctaccctgagattcaataggttactactggaacaaaacaagaaggcaatgattatatgtattgtaggaggcgcagtcgggtttgtaagaacaaattcagtatttccacattagagtccacaacataaagatgtagaactccatgtgaaaacacctcaaaatttacaaacagtcagaattatcagatgttggatctccgtaattttcagggtaattgaaagtggcagcaaaaatgtttttatttaatgtaatgatgccattgccttttctggatagtatcctatgatctgcccttcctctgaataaggcattttgtaaaaactgatgaaaatccaagagattagcctgtaggtctccatttataattatagtgactcttgccttaaagtcttttgttattttcccccttatttctttaggatacattagtcattgccttagtctagcttatggttaaacagatttctatttttgttccttgatacagttaacctaacttgaattttcagaattgatcaaaatactacatcacccctgatgctaactctctaatgggatttgaataatgtactgctatataccatctggaaattgattgaatctcaaatactaggacgttgaattcaagaatgtacttttatccttttgtctcttctgagatgctaggtaatattctataaaataaatgtcattcctattttttaaaaaaaaccagaagcaagaagaaaaatagttcattttatgagttgtataaataaatcttttttaaatatagaattttcaaactcaaactaaaagacaagtattaaactatatctaaaattatctgatttaatcctcactgattggggcctttaagaacaatttgccataatatgaaacgaggcagtatacatttgctgattctaaaagcaatgaacacttatgatggataattctttacatacgtaaagtacataagagaaaattaaaaagtaaatatagcctacaatcatttcttctgaaagcaaccactcttaatatgtggtttattttcttatgatcattttttctatgaagcattttaaaacataattataatttaaaagtgcctagagttctacattaattctttatatattatcatataatcatttttaaaggtgttgtttcctttcctccaacatttatatctttaagaatttttttctaattcaaaaatcatatattgggtgacatcacagaaaatggcagagtagggcacttgaagaattggcccctcactgaaacaatgataagctgacaaaaactgatggaatttactgtctcagaactccagaatctaatccagagcttacagcaacgagcggactcctaacaaagagacagggagctgaatttgggcaagagagatttgcagtgttttggctcacctgcctactaccatgcttccccccattcctcagagtggaggcaacagctgtggggatggaggccgacgttcctggtgtggctttttggtgccagggggctaataaaaccatgttctttaaatactctggttttgtgttttgtccagtatggcagtgctctgccagaattgatgcagcgactaaccctcgttttgctctccctaacttgggcaggaacagctttccaggcagtggggcctctgtcaaaagatttaaagacatgcattgctcatttctgcctgggtcaagggatgacagatgagaccaaaatcacagggaagagaaggctgaagggaaaaatttcttgggagaataaagactcagaagggccaccacctttaccagagaagatgaagggcaaagctcagaaccagccacatgtgctcagaaccagatgcatgctcaggaaagacctgagctaaccctagacttgcattctggcagatctgtgggctccaggcaggcaggtggtgaaggataaaacagagccataagtggcctggcttcatattaaagaagaatcttaagtcagggccaagatacatagtcttgtagagtagtatctttctcgtttttgtttttgctttttggctaaaggtgtttaaggaaatatttgtcagatcattggctgtccactgaaataatggagcaaagacttcagtgactacatgtgaacaaggaatacaaggtttgcaaaaatagtttgaaaaagcccctaaataagtggacgactgcagcccttaacagttaagtacagcaaaccctggggaaggtgggggatatctgacttctatagtttccagattataatattcaaaatgctcagttttcaacaaagttacaaggcatacaaaccaacagtaaagtatggcacactcagaattatactagaagtcctagtcagagcaattaggcaagaaaacattaaaagatattcaaatgaaagagagacaagtaaaattatctctagtcacaattgcatagttcctacatatagaaaatctcaaggaattcaggaaaaaaactaccagtgctaaaaaaaaaaacaaaaaactatcagtgctaataaattcagcaaagttgtgagatataagatcagtacacaaaactcagttatgtttctgtataccagcaatgaacaatctgaaaagaaattaagaagacaattctccttacaatggcattaaaaaataaaatatctaagagtaaatttaaacaatgagatgaaaaagctgtacactgaaaaccacaaaaaattacttaaggaaattaaagacccaagtaaatcaaaagccattctgtgttcgtggattataacacataacatgcttaatgtggaaaactaatgcaagtgatctacagattcaatgtaatctctttcaaaatattaatttttttgcagaaatggaataattgatccctctatttatatttttaaatcattactcattgtttaattcacaaggggcctgaaacagccaaaacagtattgaaaaagaagaaacataaacttatggttagactggaaaagtaagttttagtgatatataacactacatggcaaccacaattgatgataatatactgcatttcttaaaattgctaaaaggatagattttttatattctcatcacaaaaaaataagttggtggggtgatagatatgttaattaccttgttgaatctttctacaatgtataaatatattaaaacatcacattgtattccactaatacacacaattattagttgttgattaaaagtaaataaagaaaaaggagaacaatgttgaaggactatagtaatcaaaacagtgtgatactggcataaacatagacatgtaaatcaatggcatacaatcaagagtccagaaataaacccatgcatctatggccaaccgattttcaacaagggcaccaagatcattcagtagaagaaataacagttttttcaacaaatactgctgtgatagctggatattcacatgtaccaaaagcattaacaacaaaagaaacatagataaattggacttcatcaaaattaaaaacacatgtgcatcaaaaaatattatcaagaaagtggagaaattacctagagaatgggagaaaattctgtaatttctcctcttacaaagtttcacatctatatattggacgaagatctagtatctagaatatacataaagtacacttacaacacaataacaaacaaacaaaaaccaataaaaaatgggcaaaggacttaatgagacatttctctaaagaaaatatactagtggccagtaggcacatgacaagatggtcaacatgattagtcattagggaaatgcaaatcaaaaccacgagttataacttcacacccacttgaatggacatgatttttaaaatgtaagataaaagctggcaaggatgtagagaaattggaaaccctggaaattcctggtaagaatataaaatgagtcggtagatgtggaaaacagtttgcctgttcctaataacgttaaatatagcataaccatacgacacagcaattccactctagatatatacccaaaagaattaaaaacagatactcaaacaaatacatttacatgccttttcatagcagcaaatagccaaaaggtgcaaacatctgaaatgtccatcaatggatgaagatgaatgaataaacaaatatataatatatatattagaatatttatctgtataaaggaacaaagtattgatacatgctacaatgtggaagaacctcaaaaacactgtaggtaaaagaagcctaacacaaggggtcgcaaattgtatgatttcacttatatgaaatatccaggtaaatagataaatccatagaggcagacggtagtctatttatttctaagagctgggtgagagaattaggagtggctgctgaatggacacagagtttcctttgggggtgatgaaagtgcttggtactctacaaaggtggtagttgcacaatatcgtgaacgtactaaatgtcactgatttttttttttgctttgaaatggttaattttgtgttatgtgagtttcacttaaaagaggaaagcggccaagtgcagtggctcatgcctgtaatcccagcactttgagaggctggggtgggtggatcatctgtggtcaggagttcgagcccagcctgaccaacatggcaaaaccctgtctctactaaaaatacaaaaattagccaggtgtagtggtgggcacctgtaatctcagctactcaggaggctgaggcatgagaattgcttgaacctgggaggcagatgttgcagtgagccgagattgcaccactgcactgcagcttgggcgatagaatgagactcagtctcaaaaaaaaaaaaaaaaaaaagaggaaagcaaaaaatatattttttcacatatattgatggtttgttctttttttattgttgagtagtattctgctgtacagatgtatggatgtttgtaattacagtgatagagaacagatcaatggacacaagaggttagaggtgggagaaagacgtgattataatgaggtagcctggaggttttttttgtggtaatggtttttgtagttctcgttagttgtgatagttacatcaatatgcattatacacgtgataaaatatcacagaactaattaacaacaaatgaatacacatgaaaactagttatttagctaatactcagtacctactagttccaatttcctgattttgacaattctgactgcatggtcatctggcgtcccatgtccaaatgtccatctctacccagatgcagcagcactccatgagctgttccatgaaatatatacatttttctgttagagttcttaaggctttaatctagaacctcagggcctgatgtaattctcctattgatgttcccataaactctacacaaaatcgtctcccaccatagacacctctaatgatacagagtcttatggcttctatgacctgagtggtaaggaggctcatatcataccccagggctgctgacgtcctagccttagtgtcatgtggggtattggtcagaacggagttctcgagtgtggaaaatgctgtcttcaggacctgcagcatggtgctgccatcttaatggtgagaattgtgacctgtattcacttatccttaattcagagaaagtgccacagtatgtcaaagactcctaaacatttcagccatatggtcagccctttaatctgtgttatctttgaacttcggaactgcccatgttctaccaatgtacttgctacttctgtcccaggtgacatgaattcatcaacttggggacacatgcgatgttctgtgtaatatccagatattccaggtctctttaagcaagtgagttaatagggatctagagatgggctgcgaatttacactgttgtgtgttccaagtaattgagaattatttctcattttcctttttcaataggaatggaacagaatgcatttcccatatcagtgatcgcccactctgtgtctgaggctacgttaatctgctttagtaaagatgccacaactggcgtagaaactgctattggagctactatttatacgagctggaaacaggcccagattggtgaattaaatggatatatgagggagaacatcagcactgcattccttctgtttttaagggtagaactaaattctaccattcctcttgagagccatcttcactatgacagctctcatcccacaggaagaacaacaaaggggttctgccagctatgatgtgtatcctaattgcacactcagggaccaagcgaacaaccattgattgcatccatggacccagtgaagatgctgtgtaccagtctggcctcagaactccatttattgtctatatccctatacatgccaccatctatttgttaatggggagggttgtgatgacactttataaacctggggctccttgtccaacagctctcaaaacatgtaggtattccctttcctcagggtatgttacctacaaaaatggccacagccccctttgggaaagggctgggtgaatcattgttatacacaatgtttatggtgttgtgagatccttctacccaggtacctgacctcctcttcagtcaatgggctgtaggtatgaaaagtactcaggtctagaaagtgggccatggatcatgattttttattagagtgacttccctcatgctctgatcatttattcttgatttcaccattaataaaccctccttggctattcacctatcttgcccttacagcttctgtattctattagccacatccacagctcttttgatatcagaaacctgattgccactctgacctttctattcattaaataattgtctccactttgctgctgatggttaagcattatcaaattgtttctattatttggattacaaggatcatatcatctccattaatgataattctcccaaagcatcttctaccctcaggtctggcttacagaggatgaccacatctgagcttctggtgctggtgtccttcttatcattctatgccgtatcagttggccttgtgtggtcatttatgcattctaaaatagcttctctgagtctttgatctcttcttccatctgatgtggaagttctggcattgatactcagtggaggcgattacctctctaagggtctaagagctgtcttaccagcatgtaagcatccactctttagccacaaagatgctaaatcgctggtcacagctaaatgctcccatataaataaactctcattgtctaactccatattccagatcccttggcccagcaccctcgggttcctgttttataatactttcacagtgctttgcaatccctactgactaattgctaccgctcgttcaggggactgtcccttagaatacccagaacttttccagccaggtttggttttgccccatcccttgtttttggtctagtggccaggatggggagtgcacgtaagccaggaatagaggtggaggtaacaggcagagcatgggtcattttgcaaggcaaatcctctgcagcaccttaagcaagtcaagaacaccagccttaactagaagggtttggctccttctacagacccagaggctttagggtcacgatttcctactgtgtacttccagactcccctatccccagtctcagggtcctactcttctcaatcacagctttgatcttggccgagcattgctgctgcgattaagaattcattcttctctgctgggcgcgttggttcacacctgtaatcccagcactttgggaggccgaggcaggcggatcacctgaggtcaggagtttgagaccagcctggccaacatggccaaaccccgtctctactaaaagtacaaaagaattagccaggcatggtggtgcatgcctgtaatcccagctactcaggaggctgaggcaggagaatcgcttgaacccgggaggtggaggttgcagtgacccgagattgcaccactgcactccagcctgggtgacaagagcgagactccgtatcaagaaagaaaaaaagaagagagaatttattcttctctaaagctctgcttatcttagaaataatttctgggcctgatatacagattttttttttttaattttttatcttctgccctttggctgtagaagacaagaacctttttatatacatgccaaagaagtcctttgcttttcatattgtgcctttaattgatgatgaataacctcagccttttattgtttttctcttaggtgtcaatcatctaatttcatgacccttatggttattattttctccattacctctccaacaactgaaaaatggcatattacaccagccagtgcatttcctcctttgccatttcaccccatttcaccactgatggaagtttttgcaattgtgttgctactgcagaagaaggactccctggtctctacctatcagcaatgatgaggtgcttgttggcagcccactgacaggtgacccagctccaaaattccattttagaatctgtttcatcagaccaatcctggcattaaatgtcacatggtaactatatttgcgaaacagactgtaagagggcgatgtttatacaggtaatcttgggggttatacccttgagataaacacccatgagggagtgacggaggtagggctggtacaggaagaagttgaactatattcctgttacaaaacagcctcagcagattctctggagagctctggagcagagattgctctctggaattgtccagaagtaaggatagatatccaatgacaggtgtcattggatgtggactgtccccagatctgtccccttagagagagattcaactaagagctatcagcaaccacatttccagatctggataaattacttcttctgtcctaaaggggatgggtggaacctgggccttgtgctacagaatacaacatggaatttcagggaaaggtcatcaaaaaggttcaatgagttctaaccaggtagtctttattctaagggctgattaattcccaatttggggagcactccagcctccagcttaatcattgtgattcagacatagtagatcagactgcagaataaaaatgttaaaggaaattatttagatggaaggaaactgatcctagacgggaaggtgggttgataaagaaatgaagagcaccagatacagccatatgctagtaagtgtaaaaaatgtaaaagcccttttcttatcgtaaaaagtttttaaatgataactgtgtttaaaggacaatgataataatgttctgtgtgatttatcctgaagtaaaatgcatacaaagacagcacaaaagataagtggtaaaaatttaaagcatactgttatatggtatttacattaaatgtcaaatggtatattagtatctgaaggtagactttggtaactaaaaggtgcatattataaactgtagaacaattgctaaaaaagaggtatagttaataggcctacagtggtaataaaatagacttataaaatatacttaatccaaaattagacaagaaaaagagaaatatatggacagtgagcaaatagaaggtggtagatttaaatccaacattatttgcattgcagttagatggcctaaacactctatttaaaaggcagaggcagagaacttagattcataaagaagtaaaaccaattatgtatcatctacaaggcacagtatataagtatatagagataagacagaagcgaaaatgagaaaagatgggcaaaatactatgcaaagagtaattataagaaggctgaagtgttactaattatatcacacaaagtaaacctcagaacaaaggacattattgtgggtaaagaagaacacagcctaatgatataggggtaaacccattaagaggatatagccatcctaaaggtatatgcatataacagagcttcaaagtacacaaagcaaaggctgaatgccctgaaaacagaaataacatatctacagctgtacttgggaatgctaacacttgtttcttagccattggtagaacaagtagagaggaaatcagtaagaatatagaacacatgagctgcactaccttccaatctgatttagttgatatttatggtacactctgcctaacaatgacaaaatacatgtaattccaaaggtacatgaagtattcaaaatagaccctattccaggacataaaatgtacttcaataatgtgtaaatgaatcaaatcatataaaaacatattatctgaatcaaatggagttaaaatagaataacaagagtatatttggcaaatccatctattatctggaaattaaacaagatacttctaaatagcctctaggagaaaaaaatgcacaagataacgcagagaatagtttgcattaaatgaaaaatacaacatacagaaattacagggatgcaggtaacacaatgtgtagaaggaaatgtgtaacttataaatagaaaaatctaaaaataaatgattgaatatttcaactgtggaaggcaaaaaataaagacaataaacttaagcaaaagtaagtagaattaagaagataatgaatgatgcctggacagttgaagacgatggccacactccaggaccccttcccccagtttttctctggaaaatgtggagaacaacaagaaaggaaaagtaaacaaaaccacaccctcagaataatttgaagacagaaaataaccaaaattcaatataaggataaataagggtgggacaccaaatttcagtattcaacctctcatatcctcctctgatctgccccctgaccctgcctcaaggctttttttagaaacaaaaaataccaataaaaaaaggcagggaagaggaaagaaaggggatattcctggatctaagtttgatctaaaatcattaccagaaacacttaatctattcttaatctaaaaatactaaaaagtgtttgaattacccacaaggtatttaaatgtatgtgtgaattgaaggggcagtcctcaaaatgcatagcttcggggagagacatgacatttggtaatttggtggagaaagggaagagaggaaagcggaaaatttgaaggtcctattaagacaaaagaaaagcacaaaatcaaaggaaacacaatctttttcaccccctacatactcatgctaaaataaaatttactgaaggatctgaactttgctctattaaagaaatgggcaatgtttagtccctccaatcctttaactatgaaaaatcaaagtttaacagaataattctaagaaaacgctaagattaaattcagcatttatcatttgaggaaaatccccacactcttgataaatagtcatgaaacaaaataaaactataaattagctctccaagtgaaattaaatgtatttaggcaagtatttaggatatgaaaaagagcttttaataagaaattcaattcagtagcatttctaaacactaacaacaaactactgaaaattgaaattaagaaaatgatctcatttacaatagtgtcaaaaggagtaaattattcaaaaataaatttaaccaaggagttgaaagacttgtacgctgaaaactgtaaaacattaatgaaagaaattgaagacacaaataaatgaaaagctaccctatgttcatggattggaaaaattaatgttgtgagaatgtccatactacctgatatgatttggatatttgtctcctccaaatctcatgttgaaacgtgaccctcagtgttggaagtgaggcctatttgggaggtgtttgggtcaggggggctgatccctcctgaatggcttggtgatcatgaattcatgtgagatctggttgtttaaaagagcctggccctccttctctctctcttgccccctctcttgccatgtgacatgcctgctctcctttcactttctgccatgattggaagtttcctgaggccctcaccagaagcagatgctggcagtatgcttcttacacagcctgcagaattgtgagccaaaataaatttctttcctttatatgctacccagcctcagttattcctttatagcaatgcaaaattgactaacatgctacataaagtcatctacagattcattgtactttctatcaaaatcccaatgtcatttttcacagaaatagaagaaacaattctaaaattcacatggaatcacaaaagaccctgaatatctgaagcagttttgagcaaaaagagcatagctggaggcgtcacacaacctgacttcaaaatatactacaaagcgatggtaattaaaacagcatgtcactgcattaaaaaaaaaaacacataaaaacagacaaataggccaataaaatagaatagagagcccagaaataaatcaaacatttatggtcaattgatttttgacaaagatcctaagaatacacaatttggaaaagacaatttcttcataaatggtgctaagaaaactggatattcacatgccaaagaataaaattggaccattatcccacatcacatacaaaaatcaactcaaaatggaataaagactcaaatgtaggacctgaatctgtaaagctacaagaagaaaacatagaggaaaagctccatggcattggactgagcaacaatttttttatatgaccccaaaggcaaaggcaacaaaagctaaaatagacaaatgggattgcatcttactaaaaagcttctgaatagcgaaggaaataaacagcagcatgaaaagacaacctatggattgggaaaatgtatttgcaaaccatacatctcataagttagtatacaaaatatataaggaactcaaacatctgaatagcaagaacacaagctgattaaaaatgagcaaaggacctgaaaagacatttctcaaatggaaacatggaaatgaccaagaggaatatgaaaaaatactcaacatcactaatcaccaggattatgcaaattaaaactacaatgagatttcacctcacaattgttagattaactgttatcaaaaagaccaaaaatagcaaatgttaggatgtggaggaaagagaacccttgcaaactgttggtgggaatgtaaattagtacaactactacgaaaaacagtatggaagttcctcaaaaaactaaaaatagaacgaccatatgatctagaaatcccacctctgggtatatattcaaaggaattgaaatcagcatgccaaagagatacctgcactcttatgttcattgcaacactattcacaatagccaaaacctaagtgtccatcaatggataaatggataaagaaaatgtggtgtgtatacagtaccatatataagagtacaatgaagtactatttagccttaaaaaagaaggaaattctgtaatttctgatatgaatgaatctgtatgacattatattaataaaataagccaggcacagaaagaaaaacactggctgatctcacatttatgtggaatctaccaaagtcaaactcatagaagcagagagcagaacggtaattaccaaggaccaggggtggtggtggttcaaaaaatggtgttcaaaacatataaaatttcagttagataagtagaataagttcaagagatctattatattatatggtgactatagttaataataatgcaaagtatattttaaaattactaagagagtagatcaatttaaatgtttgcaccagaaaaaaatgataagaatgtgagatgatggttatgttagtaagctttatttaatcatttcaaatttatacataaatcaaaacatcacattgtactctacaaatgtatataattattatttgacagttaaaaataaaattaaaaaaattcaaaaagtaagaatagaaatgaacaccagaaaaaatttcaggaagaaacaaatagagtttattgaatttagaaaagaaataaaagaaaatgacaaaattacctcaaattttagtaataaattacaccatttagactcaaaagaaaatttggtaagagtcattgaagaaagattagaaaataatcaaaataatttttttaatgaggtaaaaaataaaagaatcagagaaaaagtagtggaaatggaagataggaaaataggaataacatttatattttgggggtcccccagaaaaaaagagaataagactattttttaaaactataacactgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagtttattgtggcattattcacaatagcaaagacttggaaccaacccaaatgtccaacaatgatagactggattaagaaaatgtggcacatatacaccatggaatactatgcagccataaaaaatggtgagttcatgtcctttgtagggacatggatgaaattggaaaccatcattctcagtaaactatcacaagaacaaaaaaccaaacaccgcatattctcactcataggtgggaattgaacaaagagatcacatggacacaggaaggggaatatcacactctggggactgtggtggggtcgggggaggggggagggatagcattgggagatatacctaatgctagatgacgagttagtgggtgcagcgcaccagcacggcacatgtatacatatgtaactaacctgcacaatgtgcacatgtaccctaaaacttaaagtataataaaaaaaaaaaactataaccctaggaaacgttctagaaaaaaaaaagattactcaagagtactatactttaaaaggacttatcaggtgcctggcaacattaattcagaataaccaattctgagacatatcctagtaaaacttttagatttcaaagatgaagaaaaaattttcagggcctccagcaaaagatcaaataatttacaaagataaaagaactagactgccatccaattttcaaaaggaaacatacagaggaagataaaaatgaagcagcattttaaaaaaaagcatcaagactatcagaaaacagttttcaacatgtaagaagcaagggaattttgtatccacaagctcttcttgaagaatttattagagaatgaacttaatgtatcacagtgacccaatctgaaacaatttgaacaaaaaagtaattaatgatagaaatggataatacactatataataaaataaacacctatgatgccatattagcataaagaaacacaggggaaagaccagcttttccttgtattataattctaattaatacacatagaaggaatgatggaaaatgaaagaaaaacattaagcaaacactatagtaaaaattattacaggcaagaatgatgaatagtggacaaactattggtggactgaaattagtggacaaacatatgaagacatactgtatatttacatagagttaaagcattttccctcaagatagttgttaattaaaacaggaaaaggcagggtgtggtggctcacgcctgtaatcccagcactttgggaggccgaggcgggcggatcacgaggtcaggagatcgagaccatcctggctaacatggtgaaaccccgtctctactaaaaatacaaaaaaaaattagccgggcgtggtagcggtgcttgtagtcccagctactcgggaggctgaggcaggagaatggcgtgagcctgggaggtggagcttgcagtgagccgagatcccgccactgcactccagcctgggcgacagagcgagactccgtctcaaaaaaataaaataaaaaacaggaaaaatcataactttactgtggagaaatctggaaataaaacacattaaccaaggaatcaaatttaacatcatcagtagtaagacatattgatacctcctcataatgatgcactgagcaactgaaattaagaaaataattccatttacattagcataaaaatgaaatgcttagaaatgtacttaacaaaataagtgcatgacctatacaacgaaaactgcgtaagattgtaaagaaaaatttaagaataaattgttactgaattggaagtttctgtatatttagatagtaattatccacaaaattgatatatgattcaatgcgatcctgatctaaattctatttgactattttataaatttgataacctgcttttaaatttatgccaaaatgcaaagaatcctaaataattaaaacaaccttgaaaaggaggaggaagattgtagttataatgactgatttgaagactactgattactgtaataaagcttcagaaatcaacatagtgtggttgttgtaaggattgatccatggaagaaaatagaaagacagaaaataaccaaacctacatggcaagtgaatttcaaagaagctgccaaggcaatgaaatgcattaaaaaagagacttttcaacacatgatgctggaacaactggatatccaagtagaaaagaataaatctcatctagaaaacaaaagtgcaaaatttaaagaagaaaatattgatggaattcttcgtgatgtttaagtgggagcttttatttatgtggggcaaaatgaaaagcacgaactgcacggataagaaagttgataaattgtatttcattaaaattagattcttctgattcttgaagaacatctttatatgaaagggataactatgacctgggagaaactatcgcaatatataaatacagaaaactcttaaaactcaataataataagcaaacaactctattcaaaatggttaaaagatgtatgctaacactttgcaaaggaatgtatatccatatttagacagtaaggacatcaggaaatgctcaacgttgttagatatcagaaaaatcaaaattaaaactacgaaaatggtcagaatttaaaagactaacagtaccaaatagtggcaaagatgttaaccaaacaaaacaaagatccccagcagctggtggaaatataagatggtacatccatcatggaaaacattttgacagtttctcataaatttaagtgtttatttactaactctcccaaaaattcaactcctggatacttactcaagagaaataaaaacatgtgctcacataatgacgtgtgctctattcataataacagaaaactagcaagaaccaaatatccactgacaggtgaatggagaaccagactgtgttacatccatacaatgaaaaatggaaaattaccactcatcaatagaaaggaagaagctgctgacccatgtaacaacacagatgatttgcaaaaacattgcactgaacttaaggggctcgacacaaaagagtacatagtgtatcattcggtttctttgaaattctaagagaggcaaaactaacctatagtgacagaaagtgtaccaatttttgcccattgttaggggttgggaaaattgactaaaaggggacatgagggaatttttggggataaaaatattctgcattgaaagtagtgatggttgcatgggtgtatacatttgtcaaaactcattgaactgtgctcttaaaatgaatgctttttattggtgtgtaaatataccttgataaaactgattttaaaacaatcacaccttagaggcaggctcaaagcatagcactagctctcattcatatacatagtttggctgcttgagaataatacagtctggaacaattctgccagtccaactgatcttcctattttctgtctcctcaaaactcaaaagggcaatgaaatgactttgaaaattctctgactttctagtgctaggagcactttttagaaattctgtgtggccagtggagagcacctgagaagtccatttgctcacagcaaagctgcaacctcagacctgaggtctggggccagatctccagctgtgagagaggagaggacggctcagttgcagagggtcagagtagcaggaaacctgacaagacgtaacacaggaggatgctaatcttagggtgtgaggttacagttagccacagcaaaggtgtggcactgagaacaagctttctcgttgtttctgggctgcctcccagtgctgtgttaaagcttcttggctaagacttctggacaccagcgtggagccaggcattcattcagaggtcaggtcttgcctgctgtgggttcctcctacacggcaccagcgggggctgacagcaggcccctgcaagtgcttgataatcagctcctcttttgcctctagtccagtcgacattttcttccctccccagtcagtgggggaggacaatcaattcttcatactgccctggaaagggatcgttatagtgcagccatttgcctgacagctatgctcactctgggagctcagcctctgaggtcatttgtttgccaactgcacctgcttttatgacttttcctatgtcttgacaccccttccttaaatcttcaaaaaatacggaccttagattattgactaggcatttctgagtctgaacttccattttcagaaagttgcaaatagctttcttataaaagtttttaaaaatgcaggtaagctttcttcaaagtaatatattcttatagatatttctaaaggacagagaagtaaaaaagaggactttaaaatcacctttaataccctccccttaaagtaaaataattgccatttacattttattgaatttccttctggtagggacttaatttatttgtgctctggcttgttgccagaaggatccaggatagttcacatggccagttcatggcagctaagcccttgcctattttcatttccattatatcatctgtgcttaacccagtacctgggtagacaaagcacttagtaaatactttccaaatagataggtgaataaacatcatcataagcctgagacatttcattccagacttccttatccttttccagcttatccttactctggctggatgggacatatcccagaggtaggccttatttggaaagagaagaatggttccttaagtgatgaatggctcgctggaccaggactcctgataaatgatgccataggagtattttattgtacaaactactcctgagtacatggttggataataagatctaacaattgttacgaatctataatatacttgttacaaattatgttgttacttgttacaaacacaaattactagttacaaattatgcatattaactcatttcctatgatcactccatgaaatggtggctattttatgtctaatttataaatgaggaaagtaaggatcagagagtttacataacttttttaatgtcacacagcagagacagatttgaagctaggctctctggtgccagggcctgaactcttttatccaccacaccatgatgtgtggtcaccatgctagacaatggtcatgatgttacataagcagtggtcaggaaagtccatactcttaagttagatgtgtctggaagtccatttcccactctctgccttgccagatgcagtaagactgagggagtagcaaactccagaaggcaaacacgtgagaaggccacctgaacgcggtgggtggggagtttgttgctctgtgggacacctgagacacactcttctcctgacagagcactgatggccactgaagcttctttttcttaattagtttaagttctggggtacatgtgcaggatgtgcaggtaccttgctacacaggtgcacatgtgcctcggcggtttgctgcacctatcagtcaatgaagcccagcatgcattagtgatttttcctgatgttctcctcctgccatccgccctccccaacagaccccagtgtatgatgttccccttcctgtgtccatgtgttctcattgttcagctcccatttataagtgaaaacatgcagtgtttggttttctgttcctgcattagtctgctgaggataatggcttccaacagcagtgattcatagtcacctaacttcagagaggaaacctggttctattgaactctctcctgacttctgatacgttgagaggtagtgagcctggatttcacctcgtaattcacgtggtacaggtagatattctcaccaaaatgacatcattcattcaaacaccgacaactgtagtttaaccccaagattgtaagtggtggacagagaacaggtgaacgcagacttcacggccttgggccataccttctaaaccaggagacacacaggacacatcaaactcatagcagggaaatacacctgctaacctttagtaggtgactcatctactacattcactgtggcagaatctcataaactaactcaggacaaaactgacttagtttatgaaaagacagcatagccactacagatttctagattctattcttaggtcttatctcttgcaccgtcaataactcaataacaggtcagtatttatttgaatgccccacagcatgtgcggaaggcccatttctttagcatgttaagaaatgacattagtaggctgggcgcagtggctcccgcctgtaatcccagcactttgggaggccgaggagggcagatcacgaggtcaggagtttgagaccagtctgaccagcatggtgaaacctcgtctctactaaaaatacaaaaattagcgcggtggcacatgcctgtagtcccagctactcaggaggctgaggcaggagaatcgcttgaacctgggaggtggaggttgcagtgagccaagttctcaccaccacactccagcctgggcgacagagtgagactttgtctcaacaaaaaaaaaaaagaaatgacattagtaatcatggccatacatcattcaaataccacctcttgagtcttttagtatgtgcttggccctgcagttagtgtttagaccccttaacagggtgatttggtaaaagttagtaagcagttaagctgcatagctgaatgtgatttttaactgtactcttaatcgtggtggcattacaagaaggatgtatggtagcacagggctggagggagaacaccaatggacttcctcttagccctgcacattcgctctgctcaccttatctaggagctgaacgtcagtttgttatcagaccatcaggtgatgctgtggatctgcgtggtgcgtaacacgtggggtgatgaacttcactttacgccatcccttgctttgtctcaagatccacccctttgtcctattccccgggggtctgtgcagttattctgacaaatgttgtcattcaaagaaaaaattgctggcaacccaatgtcacctgtacctattggtggggactgagcatgtttgcagaaacaggatacctaaatcctagcaaagtgcagtacgtgcccaacaaatacaagttatagctcagagaaacacaggtcctccccgtgcgggccacacaatagactagagattgcttttacaaaaacctgcaataacgcaatataataagtaaaaaataataacacagaaccaaagttccattgtggggcagtagctgctttgattgggccacggttgtgtctagagtcttgaaaagcctccactgttccttcatgtctttctttaatattctcttgcatacatatgtatgtattttacaggtgagcctatgactattccttcatgtctttctttaatattctctcgcatacatatgtatgtattttacaggtgagcctatgattgctttgattcttaccagataggatgttatccctcagcctggaaacatttgggtcatctgttgaatacatagctaataccaactggtaattttcatgcagagtgtagtataatgctttctccaatacatggtttagcagcaataaagaaaatgttaccattttcatcactgtcatccagcaacaactgaactgcttatcatgatcttctcctgccatgtgtggagatagcctgagaagatcaacaactatcaaggaggcattggtgagtataaacgatcattaattaatcatgttcctgctctgctagactcctgactgatatattgaaacaaagtttcttgctgaagaataagtagtatgaatgacactgtgttatttaataatggaagactccatgaaagcacaagacatatacatggttgatgggcattcagagttgctagtttcaaccagggatcacatttaaacttcagtgaataatttattctggaaaactctcacagagcagtaaatggcctccatattttgtagagattttcttctcttagaagtttataagaacactctgtgtgctcaatatttcagaaggggatggtttttgattactttatgccctttatacttagcagcccagcagttctcacctacagccagcattgttgggatatcattttgtttccatggcattgcccagatgaattgtctgggcaatgcaggagtggaagtaaattaactatcaagagcaaatggaagattcacttcatcacttaccagagacaatatatcatcagcattttcttgatttaacgtttgtctgggtcttgtttctaatacattttttaaaaatgaatatacagtaacatactatctgcctggcatcatgaagaaatgagcgatatcattgacaataataaattattttttctaattacgagaatgatcttattttgaaaatgaaatgttcaaaaaagaccaattgtgaaaataaaaattatctataatactataattacagcaatcgagacaacagccttaaccatcctatcgtaaattgttttagcttttttttttctattcaggctacttatatgcacgcatgtgcatatgatttacatagacttaatgtgcattctgttttataacattgtgatttaataagccataattacttttgtatgtcgtccaatatttttctaccttaaacattttgaagaatacatagaattttgtctttggagctattctaacttatttagtcaataacatagtgtaaaatatttattgtttttaattttaaattgttttaaattgtacaataataagcaattactgagaaccaccttggtacatctctatacataatccgaatatttccttaaatgaaattcttacaagtgagattgctgtcttgaagataaagtacatttttaagtcttttaatacatattgcaaaattactttccagaaagattgtagtgatttacattcaaactagcagttccatttcctcaagtcctctccaaaactagctatgtaatttattatgtgtttcttggcaaattgtaaaatatttttgtatcttaatgacattataaattctattttctttattactggtgatgttaattttacatctaatgtatattctctttacctttttattattttgcggggagtctctttccttttttaaaattaatttatttatttttattatactttaaattctgggatacacgtgcgtgcagaacgtgcaggtttgttacttaggtatacacgtgccatggtggtttgctgcacccatcaacccatcatctacattaggtatttctcctaatgctgtccctcccctaacctcccactcccgacaggccctggtgtgtgatattcctctccctgtgtccatgtgttctcattgttcaactcccacttatgagtgagaacatgcagtgtctcgctttctgttcttgtgctagtttgctgagaatgatggtttccagcttcatccatgtccctgcaaaggacatgaactcctccttttttatgactgcatagtattccatggtgtatatgtgctacattttctttatccagtctatcattgatgggcatgtgggttggttccaagtctttctaaaagatggtatacatgtattagttacccatttttatgtaacaaattaccacaaacttacaggctcaaaacaatacaaattcattttacagtttctgtaggtcagaactctaatgtggcttagctggtcccccatgtcagagtctctcacaggccaccaccaaggtgtcagccaggcctggggtctcctttgatagttcaataaggagggatcgtcttctaactcacctacgtggttttggacaggatctgcttcctttgggtctgccttttactcacgtttccattgtcacctcttgatattgtcagttttcttgcctcttctagtaacttcctttctctctgggagagaatgacctgactaacaaagctattgaaatttggttatgcaataattacaaggcgtcttattaattatttgacttggcatgtttgctagataggtaattacactttgtcttgtttcgtactgctattaacattccagaaatgtaccaacagtaacttctcccctatctcctccctcttctactctcaggaggcaaccaggcctcaatttccaacatctaaatctctttgttcctggggaggagttgagtgtgtgtgtgtgtgtgtgtgtgtgtgtgtgtgtgtgtgtgtggactctgtaaaagaagttgccaggagcctacacaaataatacctaagggacctttccagtggcaactttagagcatctttataagggaagtctcaggggtcaatcttcttggaaaggagaaatagagtttttttctgaagccaggtttactgaggaagtgcattgtttttatttacagtgcatatttatttgcagtaggggaaagctacagactcctttaatcattggtatctatattttacagctaccaacttttaccatcacaaagaataaatgacaacatggccccgatcacactactgggttggagacctggagtttgaagcagatcgtcttctattaaacacatgatgctctccagtagaatagctgaaagagaagacacttcatctttaaatcctcgctgctttattccaaatatatccaatgaggatttttatattccaggattctcaatgtctctgttgtcacaaaaagaactgtaatttaagaaccctgagtttttgttacattaactggttctatggtagaaaaagtaattatctgcctaatatcacatttttcatcttttttaattgacaaaagtcttgcttttgggttactcttagttttggtttgtttgttttgtggtatgtgcgtgtgtgtgtgtgtgtgtgtgtgtgtgtgtgtgtgtgtttagggcaccaactgcattgagctaaaatataacatttttcattgtaagttgaactataaatggtcatatgactgctgtggccagtgagacactcttagccgggaatttgagaaaggcttcttcaacaagggacagggagtctgaaggcacgtcttctgcttcttcaacaagggacagagaggttgagggctccccttctgcacttccatctccctgctccttgccacctggcatgtggatgaaatactgcagctccttccttggattcacgggggaaaccaagcaaatgggaacatggggctgctgtgccagtcctgggcttcccaccttggatttattttctgcgaaacgaaatatgttcttatatgtggacgccactgttaattgtttttcttcttatattcagccaactcctaactaataaactgtgtaatttgtgaattcacacctctgtgcctaagatttcatacctgtaaaatacattcctatgagaggttggaggaggaattggcatgatgattgggtgatttaaagagtcctcttaaccctattattttcttgttctatttagattccaattatcctacctattccaaagcctcagaatattgactcataagtctttcattagcctcaaaatgtccaagttttagtatgagtcacatcactaaaaacacaagaagagatctaatcctttaaggtatttcctcttattagcataataaagcctcattaaattagattttactataaaattgtgtggcaatttggatagaggctagatcaaaaacggagtcaactttttaatcagaaaaaaactttctgaacaaattgaaactataaataagacaacttatacctgctttggagaggaaacggttctcaattactgtagaaaatctatttacatagaattaattaatatcttaattaaaaatcattttccccaagcttattaagttttgctcattggcaacattttgctagctgttcttcacttaatgttggaataaagctggaagtactgaaacctcacagcttttgaagtcttacggaactcatacaatattaactagtttatctaaatcaatgagatttgctcttggttaatttatatctcttttagatgtagaagcagtagaaagattaaatataataccttgttcttaaattattaatatttcagagtttttatttcctacaggttatgacacttcaaggccctcttagaaaatggcttgggagaaagaaactaagaatttcactgaaagataatagaagcactagctccttaggataaatgattttcttcctgttttcctattgcagccaggaggaagtaaaaactgatggtaatactgaaatgccaaagaggactcatgagctgtaaaagtttcatctcagtcatgggagtcatttgtgacacaacaaagacagagatttttctgttgttcataagctggtttcctaggtatttcatttttattgtggcattttaagtgggattataatcttgatttcactctcagcctggacattgttgctgtatagaaatgctactgagttttgtatattgattttgtatcctaaaactttactaaagtcatttatcaattctaggagcctttggcagagtctttaggattttctagatatagaatcacactgtcggtgaagagagacagtttgacttcttttttcctagttggatgcgctttatgtttttctcttgcctgattgctccagctaggactttcagtactatcttgaataggagcgatgagatgagcatccctgtcttattccagttctcaaggggaatggtttgaatacttgcccattcaatatgatgttggctgtcggtttgtcatagatggctcattattttgaggcatgttcctttgatgcctagtctattgacagtttttatgaagtcatgttggattttatcaaaagctttttctacatctattgaatttatcatatggtttttgcttctcattctgttcatgtggtgaatcacatttattgatttgcctatattgaactagccttgcatcccaggaatagctggacttgctttgctcatattttgttgaggatttttgtgtctatgttcatgagggatactggtctgaagtttttattttttcttttttccattgtgtgtctgtcagattttggtatcaggctgatgctggcttcatagaaggagttagggaggagcctctcctcctcaggtttttggaatggtttcagtaggatgggtatcaagttttctttgtacatctggtagaatttggctatgaatccttctggtccagtgctttaatggttggtaggttctttattactaattcaatttcagaatttgatattggtctattcaggatttcaatgacttcctcattcaatcttgcgtgattttgtgctttcaggaatttatctatttcctcttgattttttaatttgtgtgcttagagttgttcatagcagtctctgaggatgttttgtatttctgtggggttcattgtaataatatcatctttgttgtttctgattgtgattatttggatcttctctttttcttcatcattctagctagaggtctatcaatcgtatttatttttttgaaaaacaaactggttttcattgatcttttgtatgaattttcacatctctaattcattaagttattctctaattttagttttttttttcttctgccagctttgggattggtttgttcttgtttttttctagttccttttggcgcaaagtcagatggttaatttgagacctttctaacttcttaccgaaggtgttgaaggttataaactttcctcttaacactgcttctgttgcatcccagagattttgttaagttgtgtccctatatttattaatttcaaaataaatttactttctgcctgaatttctgtattctcccacgagttaaccgggaggaagttgtttcttggctgtgcatgactttgggcatatcctctgagagtgagaaataagttgttttcaaattgtctaaaaagcaccacaaaaaatgtgggttactttttttctttaagctctctaagctgaatagattacattcaataaagattcatggggaagtggaagttctgcaaatttatttgatcccgtctgcatgttctccagagtactcatctgccctgacccttcgcctcctcacgcagggctgttacagaagttcagctgtaggaaaatctgaggacaggggaaagcacaggcagaaatgtcccttcccatttgaatttgtgttctagatcttttgggaagtaaagagttaaggccaaaaatttgtttcaatttctatttacttctaaaagcccatgaattacagcttcatttcctgtcctctttttacccttctaagactttcttgtgattgattagtctgtccctgaaggtcacatgtaggttgaaccctttttattgaaaaggtgcagctggatccttcctcagaagaaaaagggactctgccagatatcaaaacaacaaatgtcaccaacccctgccaccaaaacatagaagctatcagccctctggtatttattattatttcagtttatagtggtctcaccaagagacacagttgcactgttattatcattattattattttgagacagagtcttgctcttgtcgcccaggctagagtgcagtggcacgatctcagctcactgcaacttccgcctcctgggttcaagcaattctcctgcctcagcctcctgagtagctgggactacagacccccgccaccacacccagctaatttttgtactttttgttagtagagacagggtttcaccatgttggccaggctggtctcgaactcctgacctcaggtgatctgcccgccttggcctcccaaagtgctgggattgcaggtgtgagttgcactattattagttcaaggtgatgacagatattgtggtatctttatacttaatatttaagatgcatacacgatattttctatggaaacaaacaattgcaagtgtgttgtgtctgcacacatgcatatgctaccactcactcctactctctgtgatattcacaagagctcactgactccatttgatcagggtgtgcatatggtgggcaccttctatacgatgtgcagtatgtagatgaggtttggagggttgtggcctgtctttcctcaatttggaacgcctctgaagggtcttctgtgacctaggacttccatgggttttattgagacttcaggagccaacataccacctttcaaattctttctctgctcaatctgtttttctctgtcctcttccacaggggttgatcctgagaccacacccaagaaacttcctgcaagcaaaactacatttcagagtatatctcctggggacccaaactgtgaccatttttaaacattgccttactctgtactctctggagttgaattcctatctaaacatctaaactttctcctcttactaccgggtccccagcatctgtcccattcttgcaggtttgttttatggtgtagccaaccatgcatcgcgtgcctgtgtgcagccgtgctgtgctttatggcatgcacgagcagctgaatttctgaaaatcgtccaacttgggaacttttgatctatcagtcctctttgtgtgttgagtatgggctgtaattttgggggcaggcaaaagtatattgtattggtcagttttgctgtcataatacccaccgccccatcttagcatcttgctcaaggacgtttcctgctgatgtctcatgttggtggcagcagtgctgttaggtgtcttctcactctaggatccaggctgaaaagcagctctgagctagaagatgccatcctcataaaagagaacaaagagtaagcatcagctccaagtcacatgataacctttaaagcttcagcctggacaggtgtatatcacacctgctctcatttcactgccaaagacaactcatgtgacccaggattactgttgggtgacagggaagcattgcaagtaacaggcaatgagtagtttgcatcatccttgtacagcttgtacatccttttattgcttgggaacaataaaatgacatatccaaaacacctctatccaaaataccactcccatatgtctgtcactgccattaaaattctctgactttgaattaaggcactgactttcctgaaggcttccattaaaacacaaacattttattcctgagaagtaatgcatttgtccaccatcttatttacattaattattttaacctcttcatatttttgctccataatgcaaagcagcagttcgagtctgagaggttgacagtgagatgtaaagaagtataagtgaaatcacattctgtcttcttatgtgcctaacctatttattctggtgacatcttgttaaaatgatcctcttgaattgcttcctagaaaaaaaataagaagtaaaacttacatcataaaagttttattattaaagttctcagattgtctatataattactaaaatttattgaatgtttagtacttttttttttttttgagtcagagtcttgctctgtcacccaggctggagtgcggtggtgccatctcggctcactgcaaccttcgcctcccgggttcaagtgattctcttgcctcagcctcccaagtagctgggactatgggcatgcacaaccatgcttggctaatttttgtatttttagtagagatgggatttcgccatgttggccggctggtctcgaactcctgacctcaagtgatccacctgcctcggtttcccaaagtgctgggattacaggcataagccaccatgcccggactgtttaatactattttattctgcctccttatatttaattgtcataatatgcctgtaagatagacattatgattttcattagttataagaaggatttgtaaaaaattttagcaactatataattcgtatgccttataattgctgttgactgggtggcagtcacattccagtggtcactgcacagggaatcaggatggagtattgtttcctaacacattcatgactgatgctctcgggtatagagaaaacaggagcattgatgaaagagagtgagaaaagttcaaacagtcaaactttggatgtgacaaaattttaataatacactaacctagtcatttcatatatatatatatatttagttttgcacagcagtgacacacaataaacaccactattttattatttatgcctagtgttccattattggaacgctaagcaaatgggggttgcatcctactgcttaaggtcatcggcaaggtctgactgcaaaaattcaaaaaactgcaacctcaggcataagtgggttaagcttaaaagagcttttcaaaagttataaaaattctgataagagtattttgtcacaatctaattgctaagtttattttaattagtacataaatgataagacttacaattggtggtagcttagatttgatgagaaacacttttattaaagccaatttacagctgaggaaactaaggtgcacagaagctaagtaccttgcctaaggccatagaactcagggtttctgcaatagtcactttattccttgtctttcctaaataactgggctccagttctttttagcaccaccttctctgaaatgagacgaagggagctgtaaaaagagtagagtattgattttgacacaattctctgtgtcctccaaacacatacttttccacaaattaatcaatgtggtcttctgcaagttacttaaaatacgtgaacctacgattctccattagtgtgatgacaatcaccacacctgtgaggatcaggcgctaacgtaatgcaacaacaggaaatgtaaatagaaacgtgacacggaccctggcatcaagtccatgctccaggaagtcagttcccttcacctttcgtatctggaaacctcaatgggtcctcatagcctgtcaatcaatatctttcatggcttactcctagtctggccaggatcagccctgcttcgtactgcacggttgagaatgctatgacagcagaggcagctcttatttttgatgactgcagggcaagtgttaccttaagcttctggccagaatgtctcattagatgttacctgtagagtcgcagagccactttcttgaagatctgaacaaaagtataaattctgaaaagatattaaactgtgcattgctctagtctaaaattcccaagtcaaggtgattgccatgaagagagggactttggagaattcagcatgattagctggtgtaactttagctctcagtagggaagcaatatcagagtgatcaaggataccccaatagaaatgccatggcctaaggcagcaccaataaatctatcaactagctgttattgagtctgtaatgtgttcaggatttaaaatgagccctgaagaatctcagtaataagaaagaacagacaaacttatgaggaaatttatattcaaatgtctgttgtcttctattggttgctgatttgttgagtaaagaccaaaagtatgttagttactcatagcagagctaattagctagcaaatgcttcccagggtatctcagaagggtagagatgatttattaaggcttagggcctgagaaaaggcagtgttgggagattgtctggttctttcttttttttgagacagagtctcactctgtctccctggctggagtgcagtggtatgaacttggttcactgcaacctccgcctccggggttcaagtgattctcctgcctcagcctcctgattagctggaattacaggtgtgtgccaccatgtccagctaatttttgtattttcagtagagatggggttttaccatgttgaccaggctgatcttgaactcttgacctcaagtgatccacccacctcagcctcccaaagtgctgggattacaggcatgagccaccatgcccagtctggttctttgcttaggtggagaactcaggcccggggaacacagagggctcgcagtgtgtgaaggcagcatcatatcagtggggcaagtagggctccgacatggttttctattaagtgtttctgtacgttaacttgttttttaaaatcagttgactctctctgacaacattgtttgctcatgtatttaatctgatgggcaattattgagccactgtctacctaaatacctacttagtaataggataaactcaaaagatttggaagatctatattatgtcttatttccccaacgaaaccatgagttattttgttcgtaaggactgggcaccgtatgtgtgaaatacattacagatatacgattagatgtgataacctaaggcaaatcacgacccagagtgtatttacaagacttgcccctcctttatttcttcccttttgatgattggcgtcctttccctacgacgattcccacttatgtcagataaagctttaattgcctttctcagacaactcatttatacttaacagagttctccagtgctgcagaggtctcactaattatgaagttttaggcaaaatggggcagttgtttcctggggtgagagcagatgggggtatctgtttctttctcagtactcacttgcttgatgcttgtctacacttctgcttattatcagtagtgacaatagagtaaaattgtcaacgtgaatttagcattagtaggtgttggggcaaatggggacttagagataatttaattcaccatgttgaccaggctggtcttgaactcctgacctcaagtgatccacccaccttggcctcccgagtagctggaattacaggtgtgtgccaccatgcccaactaatttttgtatttttagtagaaacgggatgaagttttaggcaaactgcggcagtttttctacttttgaaataaataattggggaggagagattgaccagctcccataagcagacggccctctgaggacaacagcctctagtccctttaactccctgctcttgcccatcctgtgacctttccactcttgcagaaaaggtaattcagttcctcttttaatttcttcttgctgcattggaaaaaaaaacaactataaataaaaagtgggctgtcaatattcacaaaatctggacacgatccactctttcaggcccaatttatatctcccttcctcgaagaacatcttctgatttatctgggcttcaatgaactttatctctctggagcatctttaaaatgtatatagtcacttccacataggaaacgacttaagaattataatgtggtggactaattgttggttttgtcttactgattggattgtaaacttcttaagggtagtgaaccctgtcgtctgtattcttctcagggcatggctgcactgagcataacacggctgggtgaccacattgtattccagagggcagctgctaggggtcatactctcctctaatacgagtagacatgtttcttgccttcatcataagttctcaaaatctggctgatttgaatttgtattcttctactatccagagttacttggtagaaaaatgaggaccctctaggaattgctggagtaaagaaacaaagtagggcaactattttctgtaagcgaggccctaacggcatttagagacgggagaagaggaagccaaaaaatcttcctcaagctcaatttcgaggcctcgggaggcacaaagaagtgttgtaagttatttcaattacaggaagtaggcttaaaaagctaaattaataattgaccattttaaattatttaaacccgtagttcttaacctcttttgaatactggacccctctgagaacgaggaaagctacagatcttatcttgaaacaaatggatatacacacagacgtttgtaaataaactcaagagattcatggccacctaatggccatccgaaagccctgagctttgatggcagcaaacagggggctcattttcactctcaacagcattcctggcagcagatttaggattaaaccactgaaaccaacagccagagctgatgcatgaaaagatactctatcttaaagcctcataagtagcttctcatatgaaaaatgttattattctttagtgaggaggagggctggaggaagtggcctgcattttctaggcattaaagcctcatatggtgatctgggaaaggcactaatttctccgaagggctctagcaagttaaagaaaacagatatgggccaggcgcagtggctcatgcctgtaatcccagcactttgggaggccaaggcgggtggattacttgaggtcaggagttcaagatcagcctggtcaacatggtaaaaccctgtctctactaaaaatacaaaaattagccaggcatggtggcacgcacctgtaatcccagctactggggagtctgaggcaggagaatagcttcaacccaggagttggaggttgcagtgagctgagatcgcgccactgcactccagtctgggtgacagagcaagactccgtctcaaaataaaataataaaataaaataaaataaaataaaataaaatgaaataaaataaaacagatttaagccaactcaggatatatttggaccattcatgcattgacaggtttatttcccttggacaatcagattccataagaatagtgcaagttcaaccccaaaatcccgttaccctcttctctgcagatttctggtttccagtttacaaaggaataaaagtttacctctcatggtggggaatgaggagggcctagaaaatgaggtcaagaacttcattgggatgaggattgggagagagacagagacaccctttgtgtcaagtaaatgatctggagctcaatggaagccttcaggggaaaggaggaagatgtcactccaggaacgaggacatccaatgctagagcaagagtctgcacctcacaaggagctggagaaaccccttctcacttcaaaatgctttgcttgaacattttcagttgcaagtggaacttcaatacaagtgattatttatcaaatacatgtgtcatctcggtagggctgaaagacccccatatgaaaatgtgtctttatctgaaaccgtaattttttttcttctttgccttgcattatttttaattgacacatgatcattgtacatgtctatagagtacattgtgatattttaatacatgcctacaaaatgcaatgatcaaatcagggtaatgagcatatctaccaccacaaacgtttatcacctctttgtgttggggacattcaaaatccgctcttctagctgtttgaaaatatacaataggtcattattaattatactgacggtgctatagaacactagaactgatttctcctatctagctgtaattttgtatctgttattcaaactctcaccctccctctctccccattcctcttcccagcctctggtaaccactattcttcttttctttctccttccttccttccttgcttctttccctctgtccctccctcccccctccctcccccctccctcccttctttccttccttccttccttccttccttccttccttccttccttccttcctttctttcctttccttttggttttttcagagtcttgctttgtcgcccaggctggagtgcagtggcacaatctcagctcactgccaactctgcctcccaggttcaaataattgtcctgcctcagcctcccgagttgctgggattacaggcatgggccaccataactggctaatttttgtatttttagtagagacagggtttcaccatgttggccaggctggtctccaactcctgaccccaggtgatccacccaccttggcctcccaaagtgctgggattacagttgtaagccactgtgcccagccaactattctactttgtacttctatgacatcaactatgttagcttccacgtataagtgagatcatctggtattcatctttctgtgcctgacttattttacttaatataatgtcctttgaattcatccatgttattgcaagtgacagaattttattcttttttatggctgaataatattctatcatatacatataccacattttatttatccattcatctgctgatggacacttaggttgatttcaatttttggctattgtgaatagtgctgcaataaacatggcactgcaggtacctttttgatagtatatactaattttcttttctgtgtccatatacccagtagtgggattgctggatgatctagtatttccatgtttagttctttgaggaaacttcatactgtttcccatagtagttgtactgatttcacattcctactaacaatactataaaagttcctctgtctccgcatccttgccagaatttgttatttttgtcttttttttttctaataaccattctagctggggtgagattatatcttacgtagttttgatttgcgtttctctgaagatcagtgatgttgagcatcttttcatatgcctgtttgccatttgtattcttcttttgagaaatgtctattcagatctttttttccattttttaattggattattggatttttttcctatagagttgcttgagctccttatatagttggttattaatcccttgtcatttccttagttaaatgtattttgaggtattttttgggtagctattataaatgagattgctttcatgatttctttttcagtgagttaggtttatagaaatgctactgatttttgtttgttgagtctgtgtccctcaactttactgaatttgtttatcagttctaaaggttttgtgctggagcttttagggttttctacttataagatcatattgtctgcaaagagggacaatttttactttctccttttcaatgtagagagttttttaatttttatttttattttaagttctggggtatgcgggcaggatgtgcaggtttgttacataggtaaacgtgtgccatggcagtttgccgcacctatcaacccatcacctaggtattaagcccagcatgcaatagctctttttcctaatgctctcccttccccacctccctgccccttatttctttcttttgtctaattactctagctagagcttccagtattatgttgaataagagtgttaagagtcggcatccttgccttgttccagttcagtttcatcacatttcagtatgatgttagctgtgggtttgtcatacatggcctttatcatgttgaggtacattccgcctatgcctaatttgttgagaatttttatcatgaacgctgtcgaattttatcaaatgctccttctgtctattgagatgatcatcttgtttctctcctttattctgttgatgtgatgtatcatgtttattgatttgagtatgttgaaccatccttgcatccctaggataagtcccacctgatcatggcaaatgatctttttttaatatgctgctagattttgtttgctagtattttgttgaggatttttgtgtctatattcatcgggaatattggcatatagtttttgtttttctcttgtgtccttgtttggttttggaattagagaaatcctggcctcataaaatgagaattcccttctcttcagttttctggaaaagtttgagaagaattggtataaattctttaaatgttcagtagaattcagcagtgattttatctagtcctaggctttctgtttttgtttgtttgtttgtttgttttaacttttactttaggttcatggggaaatgttcaggtttgttatataggtaaattgtgtgccatggggtttggtgtacaaattatcttcccactcagctaatactgattcaatcttattactgtaattgttctgttcaggtgttttatttctcggttcaatcttggtgggctgtatgtgtccaggaatttatccatttctgctaggttttctagtttgttgacatatagtcgttcataatgtaatctctaattgcattctgggggcgagaggtgggggaggagctcaatatttaaaagaatacaaaatgttcagtatctaacaagttaaaattcacaaagtatggcattcaattaaagattactaaacatacaaagaagcagaaaattacagctcataataaggataataatccattgaaactaaacaggaaaaaacattaatgttagaattagcagaaagagacattataatcattgtataactgcattccatgtattcaaaaagctaaatagaagcatggaagttactttaaaaagaaatacatcaggccaggcacagtgtctcatgcctgtaatcccagcactttgggaggtggaggcaggcagatcacgaggccaggagtttgagactagcctgaccaacatggtgaaaccctgtctctactaaaaatacaaaaattagctgggcatggtggtgcatgcctgtaatcccagctactcaggaggctgaggcaggagaatcacttgaacccacgaggcagaaagttgcagtgagcggagatcacgacactgcactccagcctgggcaacagagccagattctgtctcaaaaaacaaacaaataaacaaaaaacaacaaaaaaagacatacatgacatttctagagacaaagactacaatatctaaaataaatacagtgaatgggattaatggcagattaagcattcttaattaacattagtgaaattgaaaacacaacaatagaaaccatccaaaataaaacttagacaaagaaaagattcaacagaaaaaccaatcaacaaatcatcagtgagctttggggcaatctcagcctcctatagatgtgatcagagtgcctaaaggaaggtaggggtaataaaagataaatctatgaagaagaaatgactgacaaatttcaacaaggtaaagggatgaattggccttaaacaaagtaggactcggcagagagcctggcaggccctggcttccacgaggcccgcaccatgggctccggatgcttctgggccaagcatcctctcctgtgttagtagttggtttttctcatctctacattgctatttcctaggcactctgcccaagcccctgtgtcttcaagtttatcaggaaggtgcctgagtgtctctcctgctggttttctccctgggaacactttctcagcgtggcgcctccacggcgcctgctccatcagtctggctgcccttggactccttggcagagggcctcagctcctctgcgtgctccagatctgccttggacagcaccatctctgtggccacttgctgctcctttctctgtgctgcctctgcagggtgccctgctggttcagggccatgttaataagcatcagaagtggctccttccctccatccctctctaccacctccaggttcgcagcttgctgaaagccagccatccctgagcatcgtccagctctgcattgataattggccctaacgctctagggggctgcctcagcctgagccccatccctgcccacttgctaccaccgcttactagatttactcctgaagagctcagttctcaagcctcagtttccctgaggtgatcacagcacgaaactcacaaccttccagctcccactctggctatggtcccctctgcttgggaatgcagcagctcctcccctgaataattaattattagtaggaatagattattgataagttagtattaataagtaatcacttaagcacaattacaatgtgttagaagcagcagaggatgtggacagagtttataaccgagagatctgacctcgtctgaggagtcgcaacaaattcccttggaagtgatatgactgataaaacatttaagatattggaataagaaaatgaaagggaggactcaaagaggataaattacagacagaggaaattgaagagtgagaagcttggcttttctgaggacctgaaggaggcttgtgttgctggagcacaaaagataaaggggcagtaatgagaggtcagattgtgcgggtcttgtcgaggccagacttgagtgcttggctcctgtcctaagagcaatgggataaatctttgaaaagctttaaacaaggcaataagatgattaggcccgaattgtaatgggatgactacggaatggattagaggtgcttaaaaccatttaggagacttgcaggactctagatgccttggactggattaggggcaatggaaaaaaaaagaggaagaaaacgccaaagctaactggggcacaaccaacagggagtcccaccgctcagttcgccaagccccgtgtcacttccatgtgaaatgatggagctgagacatagggtgagggtcgggggtgggcacagggagtgggggcaagaaatggaatcatttccagagcctttctatctgcgtggaattattaaagcacaagaaaaatgggagaatccaaaggtctgtaccatgaggcgccaagtggaagggtgtagaccataagttccaggagagatggcctttcttagcaagcaggtggaagctctggctgtgggaaggtctcctggaagcagttgactagagcccagcaaaggcagaagaattcggtatcctttctgaccactgccttcatctagtcccagaaaatcagtgttagatagaagagattctcattaaaataaacagaatttctcacccatgaagggcgattgcattttggaggcaggggaataaagagcttagagaagctgtgggtgtttaaacactcataaaacaaccattttcacttccctcttcacaggtgagctcttctgctcacttaccagttgtacatgtgatgaccaggccccaggacgggtctgaaaaaccacagttaacttggggtttcccctcctactccctgggttttgctgtgggcattggaaaatgtcttccagagacatgataacctttctcacttaatcattaagcaataggaatatttagttttccattttttccccctgtgtaaagtctacaggtaatcctggaaatttttaaattaaactttcactgtaaggggttcacttatctaactttatatcagaatgtacagtcaagacccataacccaaaagcgtctgtaatggttaattttatgtgtcaacctgactaggccatgggggtccagatgtttggtcaaacactattctgagtgcttttgtgagatgatgaacatgtgaactggtagagaaagcaaagcaggtcgtcctccctcatgtgggcaggagggcctggaaagaataaaaaaagactgattctcccttcctctgagtaagagaattcttgctgcctgtcttcaaactcggatgtcagctttatcctgtctccagactccagcggaaacatctactctttctgggcctggtgcctgctggcctttggaatggaactacaccatcagcaatcctgggtcagctcacttcgacagatcttgagacttgtcagctgccataatcatgtgagccaatcccctataatatatctctccctctctttccctctgtgtgtgtatgtgtatgtgtgtgtctgtgtgaatatatttctatatatgcatatatataaataaatatggcataaatatatatgcctctgaagtatctaacaatgtgttttcctctccaacaccattcattacatgtttttgtttttttaaaaataatatgcttcttttgcccccagatcacaaagcaaggcagctttctgttagtccacagtgaaaacagccttggctttaatgcagcagcctgagagagggcttggctaagaccccttgccatccagggctcaggcacaggaaactggttctgtgcacagtggtgttcaatttctatatctctcttgcttcttttctttttaaattattacccttgaaagagttgtggaactagtgtactctgttgtccaaaaagcaatgatttcttttttaagggaatatgcgtgtgacagaaaatgggggctcatccttgtgaatagctgccacagagttattgaaaaattacacttctcaggccgggcgcggtggctcatgcctgtaatctgagcactttgggaggccgaggcaggtggatcacctgaggtcagaagttagaaatcaccctggccaacatggtgaagccccgtctctagtaaaaatacaaaaattagctgggtgtggtggctcctgtttgtaataccagctactcgggaggctgaggcaggagaattgcatgaactggggaggtgcatgttacagtgagctgagatcacatcactgccctccggcctgggcaacaagagtgaaactccatctcaaaaaaaaattacatttctcagcgattatttataaacccatgaacctgctgaaattgaaagcatccagagaagctcatggaccagtctgctaagggtctcatgcctcatacccaacctggatgcatgatacctgagaaggaccattgccctcacgcttccttcaagacactagcctcactctcatgactgtgctttctcagagaaggtctctgaggggccaaagcttttacctggacttcccctgtttctctgtcatttccacactgattacctgggcacctttgttgaaaatcatttgatcatgtatatgtggctctatttctggcctctctgttccgtttcattaatctatgtgtctatcttaacaccaattccatatggtctcagttactaatctttccagctagcttttggataattaaataatttttaatattccatttgtgttctataatgcgttttcaattattcttcattttgttatgagtggttctcctagtatttaaatatttctccatgaaactcatttaccacaagcaatatacaacactgtacatctctttccccttcttgccctttattgcattgctgagaggcatgtaatttctacatatattataaataccctgatacattgttattttgcttttaaaagtaaattatcttttaaacaaatttaaaaaacaataaaccaaatatattttaaatttagctacatattgacaatacttttctgttcttcactttaacatttctgttttaacatttcttggaaggcaggtctgctaatgctaaattctaccagtttttgtttgcctgaaaatatatttgccttctgttttgagggatatttttgctgggtataaaattctgtatgacagttttttacttttaatgctttagagagtttgttcaatgtattctatctttcattgtttctgagatgtcttcattatattttatctttgtttacctatttattattttttctctccttttaagatttctcttttatcactgattctcatcagttttattttaatgtatctgattttattttctgagtgtttaatcctccctgtgatttgttgaatgtcttaggcctataggtttatagttttataaatcaaatttgtggtatttttagctgaagtttattcaattatttttcagcctcacttatttctcttaattcaattacatttatagttgaatttttccaaaggtcactaaatttctgttcactttaattttcattttattgtccctgaaatttcatttcattttatttcatttatttaatctatttaatagactaaattgctgtgtctcaagattactgattttttttccttctgctatttctaattgggtattaatcttctgtagtgagttttaaatattatttaaaaattttcagtgacaaaatgaattttgttttttaaataccttctctttatatcatctttattattttaatttcttggacatattttaattgatttctaaaaatatgtttttacaaattttatcatttctgttatttatggtcctatttctgtttagtgaggttttttcctggtcatgagccacattttcttatttgcctgtctaatttttaaattttgtgttaggcagtatgaatattatcttgtgacattctagattttgttgttttatgacattctagattttgttgttttactttgaagagttttaaagtttattcatttttatcatgcaaataatttacttgtgactcaagcagctggatcctttggaggatttttgtgtatcttttttcatgtgagtctaggatagtctttattctagaattagttttgccctaattctatgcctgagctttttggggtctctgctgtataccctgaggctcaccacagtgtctcccttctcaagagcttgcccaccaaattccaagggctcccaaatcccaatctcagccttctcaatgtagcaagcctgctgtgctctgccaggttgcccacctatgcactgttgttcagagtaattccagatacaaaggcaggggcacgatgcagcttatcttatctgtttttcttctctcagaaactatattcctgcactgtctcttgttcaacatatgaaaagagttcttttatatatttatcctgctttctgattattacagcaagaggtcaatctggtattagttgctcctggccagaagcagaagtgatcgtacaattttgtctacaaagataccgctttgaaacatttctttctatgtcttactgaaagatgtttctatgttggtgatggctttattatatgtatgtttatttttgctattcagctacatagaacacaaatgcacacatcacaaattttgcttccatctctctctcctcaaaatgttttaagctactgataataataatcctctatatttgcatggtatttcagatttcgaaagtgctttcacattctttagctcatccgatttttaaaaatctttatgtaaataaaagattcatttgtcaaatcttaaacttagatatattgggtgaatttcccacagttaagctactagttggtcaagtccccggccaagccttacctaatgtcatatatattttggatgttgcatgtaccaataacaaagggtagcaatacgactgcattgtgatctcatcgcagacatattaggttgtttgagatattctcagggtcgcattagacttttaccaccactcctaccaggaaaatagagctgaataactggtataaaaaaccaatcttcttcataaatcagtttttatttttgcaccaccattgcagtgaggatattatgaaatttacaaaatgggtaggagtcgctgagcaacatgattggtcaataagagcactcagcctgatgtataactctttatgctcatacatgtagacatccattagccacattgcactccttcatattgtcacccataaaaaagacagaaaaggtacttggggaaaagcttcaacactattcttataacctttttcctgctcttgtaacttaatgtaaatatactacaggctttcagatgcctattgcaaaaagaagctgaatggacactgcagcttcagggaaaataaggcactgaattttagacattaatgtcgccatctttttggagacaaaatcagaaaaagtaaactgaaaatatttagtttcaattatgaatcagaaatgaaataataggttattaagaacttaatctctgagcaaaaatatcttgtatgtatgcaaaatggtatgaaattagtattgcattggctgcagggaaggaggataagggggtcattagtgaagaagcagaaagcaaagtccccttaagaagctcacattcactctaaagctataattttctcgtgtgaacatcacagaaataatgcaagacaatgtacacttgtttgtgtagattatacaatgtattcaatataattcagagaattgagaaatgcatgagaatcatttgaacaaaactcactacacagaattgagttttgaactggaacttatttataagacaggagaatttaggataagagagcctgacatccatttaggaaaagaaagcctgaaatgtaatagataggtaaagaagaaaaggcagaaaccaaactctgtcacttactagctaggtaatcatggggaaataacgtttttaaatctcagtttctttttttttttttttttttttttgagatggagtctcactgtcgcccaggctggagtgcagtagcgcgatcccagctcactgcaacctccgcctccgtggttcaagctattctcctgcctcagcctcctgcctcctgagtagctgggattacaggcacatgtcaccacacccggctaatttttgtatttttagtagagacggggcttcatcatgttggtcaggcggatctcaaactcctgacctcatgatccgcctgcctcagcctcccaaagtgttgggattacaggcatgagccaccgcacccggccaaatctcagtttctttatctgtaaaataaatggaggtcatagtacactgcagtgaagtagtttttctgtcaggataggctaagaacacttcagaaaaataaaatcaaaattctcattaagtcaaaatgtagttttattccttattcatgctacatgtccaccgtgggtgagcacagaatgttactcattgtcctccctcaggggcccaggctgacgctgcagccatcatcttaaatgcatttaatctttgggtcagatagaaaagagagacttggaggaagatttcaagtcagcaattaaatgttcagcctggaagtgacatactcacaattcattggccagaacttgccacacctaccacaatggggccaggagtagaatcctatcacatgtctggaatatgaaaaaataaaaaacattttgtttacaatattagtgtttactgcaaataggttctttgaggattgtgtgaaccagtacatatcaaggtcttagcatcatgaatgaaccatattgacttcccagtaaatagtagcttttatagttatgaaggcatgatcctgtgacattttagtaaatacaaaatcacatgctgtctaataattattttaccatattatttgcaatatgtgcaactttaagataaattttattataactattttataaataagaaaacaaaacaattaagcaatttccctcatgttacagctattagccagctaagtatgaactgttacccatggaagtctgactgtaaatgctatttccagtatgcagcattgtctttataaaacttccttttcaattctatgatctgtatgaaatatgtgttttagagttgtacaagtgcattcacttcatataaaaataatatttaaaagtacattttactaaatatatgttctacattgctagacattcttataggttctatggattaagagataaaaggtccctgccttcacattgtccaaagatcaatggggaagataaacaaataaacagaacctggcaatactgtgtagtaagtaccatatcagaagatgttactgaatgcaatggaaaaacagaggagaaataattagcccagaataaatgtgtcaaggaaagcagtgtaagacagataataccaggctgagtctgcaaagtttagtggaagatagttgagaaaaagagaatggggtggaggtgtgtgttccaggctcagaaagcaatatgtacaacagcatgagaagtagaaagcagggcacaaaccaggaaacccagcaactgattatggctgtaatatagagtggggatgttggtgagggaattgcaagagctaaatctatgtagaagacattgtagaccttgaagggctttctgtgctgtcctgagagttttggattctattctgaaggcaatgaagatccattgaatactgtcaagcaaaaagctgacatgattagactagcattttagaaaagatcattctagcagatgagatgaatttgaattagaaggggttggacctgagatgaggaaatgaggaaggaggctttttcattaatcatggcaaaagctgtttaagggttgaactaacacagtagaagcgaagacggaataaaggaaatgtatacatgaaacacattaagctttttttttcccccagagtccctgtgtttgttgttctctttgatgggtccactcttacccaagatattttcatgtataactcatgctcatcattcaagttctacatcaaagtcaccttctcagagtccttcccttaccgtccctataatgtcaaccctttactgtccttcctgtagccactagtccattcgtaactctctctcctctatattgactaaaggacagccttttgcagcgtgtatcctcatctgaaataatattaggcatttgtcgattgttgtcttctttcgtttagtttgctggcatattatctagaatagttgccagcatagaaaaagtactcaaaaattcattctagaaattcagtaaagcgtatttattaaatggacagttaacagacacatcaaagtagaattctccaatattttacatacggaccaaggcttcaggatagaagcttgatctgaagatatttatttgtaagtcattatcccacagagaggatgaaaagctcgtgtatcagttaagatgccttaagcttcaactatgagaatacccaaataaaattagcacaaatgatagggattttatactattttgcagaagaataagttcagacagaggtagataggtacagggttggttaatttatctataataaagtcagggggtctaaatcaactactctgtgattgacagacagtttccaaagatagctgcctttaattccttccttccatctgtgtacatagttgctcacatgaacatgtgtagcctatttctctttcccttctatcataattgtttgtatttttgaaaacatagagaatgcatcattaatatttacacatgttactatatgtacactttgcctcgctgggaaaaaataaacaaatactgaattctagttagtgataagtatgttgaagtgtttagggggaagtatactcatatctgcagtttatttaaaatgtatcaataaaataagactaatggatgaggaacgattacatagctatgtggtaagacaagctaacaccacgttaatggtagaatctaagtggtggggaaatgaatgttcaatgtaggattctctcaactttactgtaggttttattttgttataataaaatgttggagaaaataactggcttaggtacccaaatgctcaattttgtaagacttctctgggtaaaatgtgttcccagtaaagccaccagcatcatcttttaacagtctgcatataacaatactgagcgtacactgagtgtctcttcagtgctgctctatcagtctggtatgtggtacataaaattctggaataaatggggcatagatcctggccttgagcggcttacagtttggcatatcattaataacaatgaaatgctagagtttctcttatagaagcatcgatagggcacgagggtaataaagaggtgacattgtaaccaaacgaatgaatttactttggggatgaggtttgacacacaaagaaaaattaaaccagatagggaagagaggaggaggtgagcaggaaggaaaagtcacgccagaggagtagcatatgagggaggatggtttgggtaactaaaatattgactgttgctagaacaaaagaagattaagatgagtgctgagggatgggatttgaagggtagagaatgaccaccttgttcaggactgatggacaaacagtggcatttgcatgtcaggaaaatgcagattgataaatgttgagaaagatcacatgtaaatgatcattagcttgccaattatgcagaacggcaaggcagattaactctttctttaataacagataaggaaaaaccttagatatgtgggaagaaaaaagaactaaaaagccaatgaattcttcccacacataaagtttatttccatgaatgttgagacatggcattggttgtgccagagacttaaggtatcatttggatgtaagtatggtgattcattcattcaccttcaggtagagaatcattgcttcaaagacgagaaatattagcctgagcaatattagcaaattgaggttgtatttccgaagtcctacaggttccagacctcccatctaaagaagagctatttgttgcagtaatctgaaattctgtcagatttgcagagttaagcaactggaagtttaaattgaatgaacattctggtaatggatagatgatcaattttaaataaatcagagaccaaatataaacacttaacactaagattgaagggaaatttgttcctcctccaatcattctagttatgaacatcaaggttcataatgaggcaaactgtgaaacccatgctttatttctgttttgtttttttggtggtgcaggtaccatagaaacactaaactaccagcaaagaggcttcaaatgcaaataaacacttgatagaatgccccataaactagggtttactgtatttggaaaacatgaataaaatcaccacaaataagttttatgttatggaatttaaatatctttttaatgtttctgagaaagaatgaggtaattttagatacatctgcccctccctgcctcaggcttttacttctttaatgcaaaaatagaaaacattctgaacaaatatatgaatggctgtgtttttctacatatttagaaggaaattgcttaatccatcaaggtattttccctaggaaaatcgcttggaagggattgtccatgtcttttgtttttgagagatgccagcatggttttgcaaattgacacatactttcccagttatctctggaaggacgttttgaccgctgctctttgagacctgcagtgactttccattctgcagagttcttcccctttccctaccgcacagcgctttttactctacttgtcggcttatgtccaaatataatctcaccagtgtggaaaggtttgactggtgttcctttcgaaatactcttcctattttcctccctgaggcattcttacccctccatcactgccatttcagtcacgaaattctatcactagagttaacttagggtgatctaccgctaattcccctttcccgctctccacctggagaattaaaaacctccattttgaaattaaacctccaattgaaaacaccaagaagaccaaagtggggggcattttacactctttataccattttatttgctatgatctggaatgtaatatccccccaagacatggaattgaggacgtgaccctcaatatccaatcagatatcaactttaaaatgtctacttaaaaattagaagttggtcctgaaattttttgcaaagtcagaaagtaagaaagtgaaaagaaaataaaagggataagagcttgtcaaaaggtgatagtacccaacttgaaagagttcccaatgaccaaaccaggaacaatcagagaaagaaaataaacactgaaattatttcaatataattcaaagtataaatcataacttgtgaatctatatggacaagaataaataatcgaataaataaatgaatgaggaataaagaaaaattgttccttaaagaagatttccaaggaagaaatgtgggaaatagaaaatcatcattagaacactagaacaataattgtttcaagcaagatcctctgatgaatgctaaaattagtaagcagaaatttaaggtgaaaaactttatgtagcttcaatgcatctcccacaaaatatgtattaattacaaagagaaaagtaatgccttcacagttgagcagtcttgaagataacaccttaaccaagtgatcactttgattacttactaataaaatatattaatatcatattaatataatatgcccctaatataatacacaaattaagcaaatcataataatggcacatcatccttgtgaaatttccccctaacatctgtaacttcaatttaatcatgaaaaaaaatcagacgaatccaaattgaagaatattttataaaatacttgaccattattccttaaacgtgtcaaggatatgaaggacagacaaggaaaagctgaggaacgaccacagattggagaagatgatggagacatgcagccaattacaacattgtattaattcattttcacactgctgataaagacatacctgagattgggcaatttataaagaaaaagagttttaatggactcacagttccacatggctgaggtggcctcacaatcatggtgtaaagtgaaagacacatcttacatggcagcagacaagagagaatttgtgcaaggaaactcttataaaaccgtcagatcttgtgagacttattcactatcacaaggacagcatgggaaagacctgcctccatgattcaagtacctcccactggattcctcccatggcatgtggtaattgtggaaactacaattcaagatgagatttgggtggggacatagccaaaccataacaaacataaaattctggattgcattttggattcaaataaaaacattagcagaaaaactggtaatatctgaataaagttcatcatttacctaatatataccaatgttgatttccctgttttgacaattgcaccatggctatgggagatattaacaacaggggaagctgagtgaagggaataccaaaaatctgtaatatctttgcacattttctaaaagtttggcattatttcaaaacaataagctttttttttaaaaaaatgtagggtattcctgagactagaatgctcttttaacattcaggtaacatggaggggttatattaagcttaaagttagccatatcagctaggtctttgtcacataaactaaaggtcctgactctatttttgtgcaattgaatttctgtgaacttaattgcaagagcttcaatttatcattattaaaaaatctctagtgggggaaggagggatgaataggtgaaaaatgctccattccccacctatttttagagcagtgaagctattctaatagtggcacatgacattatggatttgtcaaaacccatggtacacgcaataccaagagggaactctaaggtaaactatgaactttgggtggtaatgatgtgccagggtaggttcattcattgtaacaaatgtaccactctggtgggagtgtgaatggtggcagggtgggggggctgtgcatgtgtgggggcagggaatatacaggaaatctctgcacttttcactccgtttttctgtgactctaaaaccgatctttaaaaaaaaagtctagcaatataaaaaaattataatcattatagctttaactaactattttagccaaatgagctctttttaagtgctgagtctgttattcaacatatgtattactattcttaggaggaaaaattatgaaaattttaaattacacaactgaattttataatataaataaaatatatatcatttataatcatataatatatttatattatggtataactaccacattcatattttcaaacttggcactttcagggggttgtttttggaagacagggctaatgttcatcttgcaagccattacatctatgaagcacttagtgatttactgtgttttcacaaatactatgccgtttggcattcacagctgcaagcaaactgctgcaccatgcttttagaatacagaattatgacattgtaagagaagcatgatgggatctatggcataggatcatccaccaagtaactgtgttgattggagattgtgatggaccaccacatgcctctccagatcactcccttacgtttgctacccaggagagcctttagaagaaatgctgacagggagggaggagtttcacacttttgtttacacatagaaagggcagacccctaattattaaaacagtacacaaattggaggattggaaggggacttaatgtaggattgaatttcccaatcaagaagaaaataaaaagaatctcccttccaatattgtcaatgggcaggcactgagctttggaaagaacatttccactcatgggtagttctctgctctacaagggagtccagtcctttcttaacacgtttagccattgatccaaaatgtgatgtcctattaatagtacccattgttttcattttcctttctggagctctacagtatgtttaattcatattccatgttcagcctttaaagagatgaaagctgataatatttcttccctcgtttccgtatttttctttagtagattaaaaatctccagactcttcaactatacctgatgtgatatggtcttttaatctgtgctaatttaccctctccaaaattcccaaaagtatggaaaacttctggtcattttcactatgtaagccagcctgtaacagctcacctctgagcttttaaaaactttcagttttgaagtattctggattgcaatttgtacttactcttttatgctacaataaatgttaaaattttctttgctgatttgacttgattgttgacagtttctggtgtcagacgtgggagcccaaggagctccctgatgaccctcaatccctcaaaccctcaagaccctcaagatccataagcaggtgccaacacccagagagcctgttgtgcttactccttccttgccaaccacagagctcatctgatgaggccctcttggatctgagctcagctctcttggtgcttgacctctccacttgtaatatataaaagtgttattttcagtttgcttgggttagcttaggaaagtcacctttttctgttcaaagtgggaggatccatgtttccctggatgccagaacagtagctactctggatagacttcccattgcttatttagcattgcaagaaaacaaaaaggcagaatagcatcttcccagtccaaagcaccccaaaattctccatctaaaactctggctggttatgtggttaaaatctgtggactcagcaaggcacagtggcttgcgcctgtaatcccagcactttgggaggctgaggcgggtggatcacttgaggtcaggagttcgagaccagcctcaccaacatggtgaaaccccatctctactaaaaatacaaaaattagccaggcaagcaactgtaatcccagctacttgggaaggtgaggcaggagaattgcttgaatctgggaggtgaagtttacagtgagccaagatcatgccactgcactccagcctgagtgacagagtgagtctccatctccagaaaaaaaaaaaaaaaaagcctatggactaggctcttttacctttctagagaagtgagtgaactttactaaggataatctggaattgcaatggctactttggggaaactttaacttggataaaaagatagctcatcttaaagatgtccttgaaaagggggatataaaagctctcaaaaacaatggaatacttcttttattgggatggagaggattctaaaagacaaagtggttctaagatagcttcttcacaggattcttgcagcacgctaatgagaaattaaacccttaattcagatggatctgatggaactgacagaatcacaccttgccagaccctctgctcctttctaccctccattgcctgattaagccaaacctactaatcctcttgatcctgtcctcacctcccaaactcccccaacatcagatgccttctaaagtaggatattcaagtaagccagagatcccaccctcagaggaatgtagtctggtttggagctgagcttcaacccattataaaagattttccagagcccaaaaggaccaaactaaatttacaggaaaatttgaaattctccttggtgcctatgattctgcatcttctgatttatataaaattatccatacaatagcaaatccaggagatactcaaaatggcttcaaataataggttggagaaagtctaccaaagattttgagaaccctactaaagatacctgcagagacgaaacaaaaagaggcaaaaaattaatccaaccgcttcttgaagcagttctcaaaatttttcttgtgagaatagactgtgctataacacaatcttttaaacagaaaaggggtaaactggtggcagatttccagacttccacattagtttagaagagatattcagacaatgctctggcctcaaagatcctgggactggtattgctacatctgctcatttatttagctagctttgcccagaactctgtaatttaccagagaaacctaagtcagaatggaaaatcaccccctcccagagcttccctgtcttgctaaatatttcaaaaaaagcaatagagcagggaaaaagctatcaagcaaataaactcatggccttccaattataacaatcacagggaccttggttcaacttcaaaagatccacccccacttaaaattttacccctattgattgagatgtctacagaaactgtcaacaaaagagacactgggaaaaaaaaatccccttttaaatcatgggccgattaaacatcttagttgccctgtaagacagaatcatgaagctaatcagattcttgtgttgactgtcaatattgacaaagctccaaggaatcacctagttaatttcaataatttatttcaatcagtaaggagaaactaaacttgaagtaaatgggggaaatgtgtattgttttggtagatatcaaggcaactctacattaaatcctacaagaatacatcaaaatcttccacagagtaataaaaatatctcaatggtgggcatttcctgtcaagttcaaagagtttattgaaacccataactgtcacccttggcatcttcccttaaagttacacctttctcttatgtgatactacccctgtaaatttcctcagtagagaaagaaatttattttgatttcttacttgcttttcaaagtaagaggtcaaattaaattttctctaggaaaaataaccttagttacaccagattcatcagacattgaaatgttgtatgttcccgggtccgaattgattgtcctgaggagactgttaaagtccgtaaaaatataaatattatagatgtctctgaaatttctgttagctatggacctcttcttctacaaatatagaaaaaaaattaaaagtgccagacatattaaaatccagaatgatctttcaaaaccatgtcctaggtaaccttggtatcccttaagacttgaagaaatacaaggactcactcctataatagatgtaattacacagaacctttgtcctcagacagtgttttcagcatccagagatggacactcaaagcaaaggctgctgcacacctgacaacccctcccacccacactcctcatgtcaggtagagcccttcctcacaaggcaggttagagccccttgtcacagctcatcatctcactcttttgaatttaaataaaaaatgccagctccctatccccgacctctcccactgttccatgaccagttgaggttcacaggccttagtcagaacctggccccccgctgagaccccattctcaggcatcctgcaagagcccgtctcagctaggtttctgcatccctctggatcctactcggagttacaggcaggtgtatgggctggtgcaaggtggagacaggacctttagtggaggctttgtgagttaattttgagtgtatgaagctcacctcctcctccccagaggccggttacagctctcttcccactcttgccttctctgcttgtcacaggacaagggtctggcagattgcccaccagctaacgactggagacagctctgcaatgcactgggcttaaagtacagtaattgcttaagaaatactcgtggatggctgtctgcacagtgatcagaaacccattctttaagactatttttgacaacagaaatttcaaatgctttgttaatccaaaatttctactattctctaaaatagaaggaaatcaggagaagaaaaggagggagaaagcatgggttagtaatcagcacttgctgtttctgtttcttggtgttcgcggcagccactgtgtcacctggctggagtgtcactgaattgagtgcagtctggacgtgatggatcaggctctaaggtccactgtgtatcttcaacctgtcctcctggcccagcagacgggcctgtccctcccttctccctgtagttagcctctctgcacacatcccgtcacaccccggcccaaagggttcctcaaaaatgggtagccatgttgggtttaataagaaaatgtggaaaataagtgttggtaaagaggtggaaaattggagcccctgtccactgctagtgggaatataaaatggtgcagccattgcagaaaataatttggtggcaccgaaaaaggtccacgtaaaattatcatgagacccagccattctgcttcaaggtatacacccacaagaactgaaaactgagactcagatacttgtacagcaaggttcattgcagcattaaaaactgggactgaggtgcttgtacagcaaggttcattgcagcattaaaaactgggactcaggctcaggtactcgtatgccgaggttcattgcagcattaaaaactgggactcaggctcaggtactcatacaccaaggttcattgcagcattaaaatctgggactcaggtactcgtacgccaaggttcattgcagcattaaaaactgggactcaggtactcgtatgccaaggttctttgcagcattaaaacctgggactgaggtactcgtacgccaaggttcattgcagcattaaaagctgggactcaggtacttgtacgccaaggttcattgcagcattaaaagctgggactcaggtacttgtatgccaaggttcattgcagcattaaaagctgggactcaggtacttgtatgccaaggttcattgcagcattaaaagagtaattactatctaaatatacagaaactcccaattcagtaacaatttattcttacatttttctgtatcttcaaataatagatacagaaacaaaattaccacagatttcttgacccccagagcttctgattctaggatgaagtccaaagttttgcatttctaacaagttctcaggtgatgctgatgcttaaggcccaggtaccacacttttataaacaggctttcaataatgagaattcagaaatggcagcgtacagcatgctgggatttgaagggaatgtggagcaaatctgtgaactggataggatcaggtcataaaaccacacgattctaagtgctgggcatttactgttcttttccgtgctacatgctggtcagtcttccaaaccaaggcatcgctctcccataaaacacatccgaatggagagtgggggatcctggctcctccactgtttctcttggccgggaacaagctctgccctgggcttgccctgccctccctgggcttggtttgcacaggcagcttcccacacacaacttctctccacaggtgggctcatgcccagctaaaggttcagaagacagaaaccagtgggctactccccttaccttcaagactgtgaaagctaaggatcaaacctgactgagaaggccaaggcggccacatgctcactgtggtccctgtcccctgataaagcttgccgaatgcctggattccaagatgggaacagggcaatggacagaccgaagggcaagaccaaatgtgggctgtcgcctgctgccttttcactgtagtctcccctttggagtaaatattgaagatacagagcgaatgctatgtacaggagacaaagtcttcctcttcagggaaggaggagagcgaggggaggttggtaaccacccttacgctcaacacacacaggctcactcacgtgcacaacactcacgtgcacaactctcggagctcctgagggtgactgcctgttattacacattacatttgacgagcacattctcaatctgcgtcagttcaggatcatgtgaaagaaattatgtttttactctcatcaaaacaaaggaattaatttaaattactgtgtcccttctaaagatctggaaacaaccttgatttttttccccaggaagatacaaagagagaaacaataataatctgatttacacgtcaaagtattttttggggggatatcattgttactttgttttgttttaattaatctcttcaaaggaccgtggaggagaaatggtgaagcctgagttgagaactgaaaccgaaaaggcaccttttttcccctctctttgatatcataaagtatttacagctattaaaattaatttcttatgtattcatttaattatatgtattgagtgtctactatgtgctgaagctatgctaagaactatggttacaaaagtgaggaaaatcaagcctgcccgtgctatcagcttacagcctgattgtacaatgaccgtaaagtcaaactgaaggaaaatgtgaagcaaatttgagaactaaagatgatcagatgataaaacttcacaattctaagtactggccattcactgtcctttttcatgtggtatactgggctgttgtccaataccaaggtatcattctcccataaagcacacgtgttttgctctatgagaatgtattaaaagaagatttaaaaataaacaaataggcctggtgcggtggctcactcctgtaatcccagcactttgggaggccgaggccggcggatcacgaggtcaggagatcgagaccatcctggctaacatggtgaaaccccgtctctactaaaaatacaaaaaaaaaaaaatagctgggcatggtggcgggcgcctgtagtcccagctacttgggaggctgagtcaggagaatggtgcgaacccaggaggcagagctttcagtgagccgagatcgcgccactacactccagcctgggtgacagagggagactccgcctcaaaaaaaaataaaaataaaaataaaaaataaacaaataaaatatgtttataaaaaaggatttaaccttgacagaaattgcagaaaacacattcctgaggaaataagctggaaccctgaaggtgtgtgtttgtgtctgtgcaggtgtttgcatgagggtgtcacctgcatgggtatgtgtgctcatagaccatgagagtattgaaaggaacgccttagaaagagacagcagcatcggcaaagacccatcataaaggagaggatgcagattctgcacatgtgtcccagaatttaaagtaaaataaaaaataaataaaaaatattctggttaagtgtatctttctctatgtgtatatatagtttcatattttggtcaccagggaaccatatgcaaagtgatatgcatagatatatgtgagtttcacttaacacgtttctttatgaaactgaagactcctatatatatatatatgcaccattataaatcatacacagatagtgatatataaaatatagtaaaatgtgtttaataccaaaagtacaataaaaataatacaatgttttcttgctaaagcacttgaggatctatattttgagtccaccattatagatgtcaattttctttgcaggcccctctacatacgcgaggtttggaaatggaaataatgtattacataatagaaaatatctaaaacaccaaaataaactttactgttaggatgcggcatggctcaaaaaaagaaagaagaaaaggatgacctccagggactgaacaaggacagtattgagagtgtgcagagaatatgggcatgagataaccggagacggacctttcaatatgggtctccatgttcagtgtctttgttcttattttatatattgaaagaggaaagccactgcctttctgttcgttccttatcttctcagcctctaaaagctgacattagtagtagtggcataaagcagccattctcaaaagtgtggcataggaacccctggggttcctagagacattggtttatgagagtccatgatgtcaacattatttttataaaaatactataatgtcactatttttttctcattgtctcatgagtatacagttaaaagtttgtgaatacattttttgtttccccattgcaactaacctttaagaaattaccatctgtttcttattggtggaaaatcaaggaagaaggggccgggtgcggtggctcacgcctgtaatcccaacactttgggaggccaaggcggacagatcacgaggtcaggagatcgagaccatcctggctaacatggtgaaaacccgtttctattaaaaatacaaaattagccaggcatggtggtgcacacttgttagtcccagatactccagaggttgaggcaggagaattgcttgaacctgggaggcagagtttgcagtgagccaagatagcgccactgcactccagcctgggtgacagagcaagactccgtctcaaaaaaaaaaaaaaaaaatcaaggaagaatatctgcagttttcttaaaagcttattaaaataacatcctttctctaatttgatatctgtgtgaagccaagttttttttttttcatattcttcaaccaaaataaggtattgcaagagactgaatgcagaagcaggtgtgataatccaggtgtcttcccttgggccagatgttaaagatatttgaaaaaaaatacaaaacaatgccaatcctctcactattttcttttgaaaaacataatttgtttgtttttgtttctttgagatggtgtctcgctctgtggcccaggctggagtgcagtggggcaatctcagctcatgtaaaacaatgacgcacttatctagccacatgtaggttaagatagccaaagtcattttttaagtgagtgggcataataaacaccaagtttagaatggtggtgagctctgggcagggagggaggaaaaagcaagtagatcgaagtgagcaggatttgtgactttttaaaaatttttttattttttgagatggagtcttgctctgtcgcccaggctggagtgcagtggctcaatctcggctcactgcaaactccgtttcccaaattcaagtgattctactgcctcagcctccagagtagctgggattacaggcttgggccaccacatccggctaatttttgtatttttagtagagacagggtttcaccatattggccaggctggtctcgaactcctgatctcagatgatctttccgcctcggcctcccaaagtgctggaattacaggcatgagccactgcacctggccaaaaaatatagtttttaaataacgcaatttatttgtattaacatagaatgatattattatcattttaaatgacttaataaagaaatatttttaaatactcttaattttaattctaatgtgttaaatatcaatttgctataatccacataagaaaaagatctttgttgtcctcagtacattttaagagtataaagggctcacaaaaccaaaaagtttgagaaccatgatgtaaagagaaatgcaaagcaatgttgcttctctttggacctagatgaagtaagagccatctaatgttatataatatggggatgctttgaaagagtttccaccaaactgccttctggatggacttgttttgaacccacatctcttgatcatcaatgcactcactgagataagaatgacttcctttgttaagattcacatcccaccaggtcagtggcatattctcatccttcagtgtatatgactgcatagaacctacactaaaaggaaaattatctgtgagttcttctttacagcaagttagagagagattcaaatggtctgtccacaaggagagtgacagctgggggaatgaagggcaggaaggtaagcagaggtgagggttctcattagcctttatgccactcgatagcattgtctgcttagatagctcccagatcacacagtacactcattttaattcaaatttcacataaacaacatgtattttattttgtataaatatgtcccaaatcttgcatgggccatacttatactaaaatataattggctgtttttatgaaattcagtaataactgagtgtcttgtattttcattcactaaacctgctaaccctagctgcttaggaatagatactctgcagcttaagtgtttgcttcattcattgctttttaaaatatcatttctgttaagtgcttcataccttgtaagaagataaagaaaccagtttagtttttaagagactgagcaaaagacttctttgtactggaattggtggcatttgatgcatacttgcataagtatgtcatggatgaagaatttttgaattttttttattctagtagaatttgttgtcaggtgacttgtcccatatatttagttgctctgcccttaagtacatagatagcagtcttactttcttacttgtacatttgcttctctatctcttttattttttttgcaatgttttcacattccttcagttaaaattaagcaaatagaaagcactattttctaactcattcttttattcagttcaattcaatgattatggaataagcaccaactctctgccaagtgttctccaaggtgctggaaacagcagcattaacctaacataaaaactctcagagtggacataacattgcagtatggggagacagactctataaatatcatagaggtggtggtgtaaatagtactgagaaattaagtctggtaaagtgctaggtagtgccagggtgtaagtggatttgatattatagatatggcaattggggaaagtctcatttataagatgatatttcaataacaacctaatggaagtatggggatgagcaatgagaccatctcagggaatagcattgtaggtagagggacaagaaagtgtgaggggctcagataggaaagtgatttgtcagtttgagaaatggcaaggaggccagggtggctgaatcacgatgagaaagaaggagagtggtaggaaatgaagtcagttggtagtgaagagagggtacagtgtgggcagaatacatatagtctgataaaccataataaagacttgcaggtaggatgtggtggcttctacctgtaatcccagcactttgggaggctgaggcgggtggatcacctgatgttaggagatcaagaccagcctgaccaacatggtgaaaccccgtctttattaaaaatacaaatattagctgggcatggtggtaggcacctttaatctcagctactctggaggctgaggcaggagaattgtctgaacccaggaggtggaggttgcagtgagccgagatcgtgccattgcactgcagcctggatgacatagcaagactctgtctcaaaacagacaaacaaacaaacaaaaacacttgggcttttgctctcagccagataggaagctacctgtggttctgactcgtgtttatacaagttcattcgcagtgttataaagaagatgctgtgaggtactaagaaaggaaacaaggagagaatataaagggtggtttcaatatgagataataggagagaatgaaggtttaatctgggaaggaagcagtgatggaggagaagctgtctgactttggataatatttataatgtagaatcagaatttgctgctgcattggacataggctgtaagagaaagggaggagtaaaaaatgactctagcgtgtttgccctgaacagctagaaggatagagttgtcatttaccaagaggaacgtgaaataaggaatgagttgttctgttttgggaggggaggggggatcagctgttgaggtttatacataaattagagacgcccactagattgccaagtagagatgctggtgatgctgagagctcagttgggtaaacaagtcacaaatgacaggggcagatcaggattggagagaaccagaagcagcagctacagaaggagaaagaaaagaaaaggcgaagtaacgtgtacacagggacacagcgtgtggaatgacagacactggaggctcggaaggagccgggtgagagggagatggatgacgaaatattacttaatgggtacagtgttcattacttgggtgatgactatactaaaagctcaggcttcaccattattccatatattcatgtaacaaaattacacttatgccccttacatttatacaaataaaaagatagtaatctcagcttcaaacgaagggtttcaagaaagagacagtgatcacatgatgctttgtgatatgcagatgttggttaaaatgaggactagattaacccctgagtctgacaatagaaggcatgatgtctctggcaagagcagtgtcaggtgtgtggtggacaggttggggcaaattaaagggaaaatgaaagggaaaggagtgggaaccaagagcaggagacagatgtttcagggttcccctcttaaaggagaccacagaaatgggacagtagctagaaggtagtgtgggtgtcagaaggactttttcccttagcataggagactttagagcatgcttatatgctggtggaaatgatctaacatattaaataaatagatgatgcaggacagtaaaatgacaattcctgaagcaatatacttaggcacatgtctctaacaaatggaacaacctcgttatttggagatatggagttattcaatcttaggaaaattataaatttagataattggctagcgatgttttttagcaaaagggccaaattagccaattaagaatgtgtacaagctgcttttctccttcaaaatgaaaatagcatattgagctggaaatgaaaaatgcaggctttaataacttaatttaaatattttattgattaggaaaacatgaatgagaaaatgccttttttaaaacaattacattgctaatgtctgagtatctaagcacatggaagtatcattctaatattttataactttgaatgtaaatgcattttgagtgtttcagagcatggcaggtgtgtgctgggacaggcataggcataggaacttgctcacagaccatctaagatcaaaggccccagctgctgcaacctgaaatccatttttgaggtcatgcttcctggaggttgcttttggacaatgactgaacatgcagggatacagaggcaggcccattcctgggacacatggggctttgatgggtgtctccggtgagtatttcctcatggtctggccaaaccttccatcaactgcactgtggtctggaacgcgttccctcttcctttcttcctcttctcacctgggggcctgacttgcattgaggttgttgcctctcccagcttcttctagctccctccctattttatgtcatcggtgtttcctctaataaaatatttacaacattattcacatctgtgcatctgcctcttggaggattcagactaacgtaagtggtaccaggagtggcctaggaaggtaagacaggacttgggaggggcttcccccactgacagcaggtaaagagtgccatcgaggtttgtggatgggacatggatagccctggcacaagattgcagaccaagttctaaacatgtaattgatggtgaaccgggaaaatatcctggtggagagaaatgctgtggcaggtgcagggatgcaggcatttgaaaaatacggggatgagatggaagagtgcctgtaagacagaagagttggcaggatgctggtaagttgtactgacttgcagaaggataataagagactgaggctattaacaagaagttaatggctcagtgaaaatccagagaacctctgtggtcatttaccaagagaaggacaggcacaagtaaacagcagactggagattgtaggagtctctaaagctgtgaggcatagacagggcaggttgcttatggaaggttagaactctggtgggagaaatctggagtccagtaacctggggcagggctatctgggtggatgctggtgatgttgaccctgcaactgctcaaggatctgctgggcttgcagaggtggcccacagccccctaccaagtgccaaccctcctgctatgctgagagggctgcagaaactcctctcacttgagtcaatgggagtctcactcagcaagttccctgagtcctctgcaagctgccaagacaacagacaggtcaaatactagtacagcttagctggagacattctgtgcctgataagagaaaaatggactctgttcttacaggtttgcaaaatgtagtagtcatatgcccctaggattggatttgatgatggatgagcaaaaggaccagaatatatataatccctcaaatcaatgaattattatttatgcatatgtatggacataagtaatatatatgcatatatattcatatatatacatatatatgcataaataataattcactgatttgaaggtactttatcaggacacaggacttaacaaggaccccaagagatggggcaaattgatgctggggtggctcttagaagtctggagataatgatggctagctcttggggaagtagaaatgacacagctattgtggagttggcagagaaaggaacaaagagattgagggaggaggtcatgccaaaatgcatggctatgtgaaaccagaaggttcactggaagagtgtgttccaagagagggcttagatgactcagtgtcacccaaacccatcagggatgtgatgatgagaggggcacagcctcctcaggaaatttgttggtggctctcctttgcaggcaggccaggaatgaatgtagaagtggcaggcacagggctgggctccttgacattgatggggtgatggggtcctgaagtaatagtgtcccaggggtggtgcttaacactggaaggcaggaagcagaaaatactgcaatgaccagcaagactgatccactggagattgggggcttcccattccctccactctggactctgcaaggtgtaagtcttggtccccaaatggagcacagacttaccagcagccatagcaagagtcccattgaattgcaagtgatggctgcctctagggcatttggggctccttgtgcccagagaccagcagacaggaagtcaccacagtgatcataagtgaccctaactagtagaagtatgtgggactgtttttacaaaatgcagacagagagaaacagaagaggaacccaggtgacactttggctcctccccatatgtccttgtaccattgtgacaatggatggacatgggatgtgatcctggactgggaaggacaaaactatgaggtattagggaccctcaaaatgaaactttggattacaaaatccagacaaagaaagccaacaatatgggctgaggtgatatctgagggtgaggataattcatagactcaggaggccggggcaggaacgaagaatgtcatgtggccctgagatccactgcaactgaggttcctcccactcatctccttctgagtttctcaggaagaaaagcccacgggaaacagaggaactgtttctcaaagctgcacagagaagtaaatcagctcagtgcaagaggtggattgcggtggccatcagaacgcacctgccagacctccagctgcagggagtgtaactgacccgggacttaagttgcttgatctgagttccatgtggcatcatacagaggacacccctgtcccacaggctgctccaacccagtgactgactatggtaggtttactaaggctggaccattcctgggaggcacggggttcccccaatgatgactcagcccaaggactccccgagggccttgcacagtggtcctggacaacttgcaccaccctttctttcctctttccctcacctgtgatcaggcttgcattgaggtctgatggctccccgagggtcactcacaggagtttccactgtgaaaatccttgtgtgcttaatcttgtctcagcagcagtttctcagagggcccaaactcacacaggcagcactcgtttaactcagcgtgacttgcgctataaagtgaagaaaaggcagcttcagcaactcatccaggatcataaaaggacttagctacagagttggggctagtttgctctagtcatggcaacatgtactgcccaccatatcgtgccaagtacgatgccaggctgtgggaatgtagagattaactgtaattttccttcttctccaaaggagacgactctctcccggggttgtagcatggcttctctgtttagtatggccagaagggatgagccgtggagcgcaggttaagtctaatgccctcagatccagagaagaattagctactccagcattccgattgtgtgtgctatccttagttggacagaggttctgctcagtgcccagcagacccagccaggtctcagcgatgaatgcagcacccgcaggaactgcactcttggcaatttccagtggctgtgctgtcacagcacacagcagttcccacaagatccctctccttgcccatagccgggatggacacccttctctgtatgagccatgtcctgattaggattggaggctagtggaggacggtgcagcaacaatgtgagaagatgctgccatctgccttttaccacccttttatcttcctatcacacctgccatcctttggcatatctagggaagatccagctttctttaggcacaaagaaaattcaagggaatcagtactttgaacttgagtggtgctcagatctgtatatcaatgtgtgatgatggatggaatcttatctgcattcatacctatgaataggtctgcattcacacctatgaatagttctgcatgcatacctatgaatagttctgcatgcatacctatgaataggtctgcatgcatacctatgcattagttggagacaaattggtaacaatggcataattgcattatactagcagagaatagcaaaagcttaattaacaggaatgtccagaactctcagataacttgcatcagttatccaaggcatctgtaacgaaatactacagatgtagctaaaacaagataaatttatttttcaccagttcaagatcagggttggtctctcctgaggcccctctctttggcttaaagttgccatcttcttcttgtgtccttacatggccttttctctgtgtgtctgtgccctgatctcctcttcttataaggacaccagtcctattggattaggatcaaccctaattaaaatattttaacttagtaatctctctgaagaccctctctccaaatacagtcacattctgaagtattggaggttaggacttcaacattaaaattttgagggcacacagttctgtccatcatacctttttttgtcattgacttctaggagaaataagccaaatttatttgttttattttgtttttaagtgtacatcaaaaatttaatttttaaaaactgttacaatatatattattgtgtcaagacaaaataaactcagtatttcaccctacatggcttgcaaagtttctgtaacccacctgaacctgaaagaagattatggtggcatgtcctgcagatcagcttttgtgagcagtggacgaatgagcggcacacgctttcctgagtagagggcatcttgctatatctagggagtgtcccactatatcttgataaagagcagctccttgagaaacagccacttagggagtggggtggtgatatggtataggtctgtgtccccacccaaatctcaccttgaatttaataatccccacctgtcaagggcaggaccaggtggagataattgaatcatgggggatagtttctcccacgccattctcctgttagtgaatttcacgagattggatggttttataagggggttcccccttcattcgggactcattctctctcctgctgccccgtgaagagttgccttccatcatgattgtaagtctcctgaggtttccctagccatgtggaactgtgagtcaactgaacctcttttcttcaatcattacccactcttgagtctgtctttattagtggcgtgaaaaccgactaatacgggtggggagaggatgcagccccttccccacatgccctgcagctgccagatccccttctacacgttcttgttccatgtttgtgccatagtcacaaatgtcctaaacggcagccatcagtctccacccaactccatgtctataaaacgtggagggcatttgttgagttattaaatcaggaaaacatactttaaaaattcaaggtttttaacaacataagccgttttgttttttcacaaagtcagggccacatcatagcatttcaagtcttataataaatctgtgtcctgtgtttagtgctcagctatattctctagagaattagcccatctctaagccatagcagtaggatggtcatatgatttaggtaagaaaattaggccacattgtagaaagcagatttttctcaaggacaactaagatattggctctgaaactggctgaaagcaagcctggtacctgcttggtgatggtatcacaggtgtttgcatatgtccaaacccatcaagttttacgcattaaatatgtgcagttatttgcataccaattgtacctcaaaaacgccgctgaaaaagaaaatttaaaatatggttcgggaggacacacagaaaaacacacacagacaaacacacagttacacacagagacacaaacacagttacacagagacacacacacaggcacacacacctagcatattttgtataataatctgtttctaacacctttgcaaataaatcacaatataaatactttggaggcaccagaagatgtaggctgctgccaggtgactctgaaatcgaacgctgctccacctggatgatgagatggacttctttgagatgcttttctgggaagggttctcaaggtaggggggccctaggttggggggtttctccatggaaaactggctcccagttctggacttcctagctggtcctgactccttcatttaacctctgtcaggaaacagagacagcctatctggaaacgaagtttctacatggtgattttttttttttttttttttttttgagacggagtctcgttctgtcacccaggctagagtgcagcagcgtgatctcggctcactgcaagctccgcctcctgggttcacaccattctcctgcctcagcctcccaagtagctgggactacaggtgcccgccaccatgccccagctaatttttttgtatttttagtagagacggagtttcaccgtgttagccaggatggtcttgatctcctgacctcgtgatccgcctgcctcagcctcccgaagtgctgggattacaggcgtgagccaccgcaactggccctacatgctgatgcttttcaagtcttacctttgggaaagaaatggaaaccattttcattatgtcttggccaaggtacgaatacagtggtttggattttgtggttaaaaaaaaagtgaagacagaatcaaactggagaggaggaggaaagaaacaaaaaggaatggaaaaggatgtaacgtgtcttgcattttaaactgcagggacagccttagtcggtttccaaaattagaccccagtgactgcctgtggtttgatgacatttttttcaatctccatgggtcataagagttcaagaaggtttcgatacattaatgaatgtcacagaagactctaaagtccatagtggacatgggccagccccgtgaggctcggcccctggttttctatctttgactatagcactaaggacaacaataataataaaaaaagacacaatcaactttcttgtttttaaaaacttatgtaagaaatttcttctcatttgtgaagagacctttgaatgacattgttgacagctgatgtgatacctcgattcttatcttcttggtttaaaagaatttaaacaagagacacacagcaaaggaggtgtagcatagagtaatttagttcaaaagaaaaagaatattctgaaagttagatgcagaagagacaggatgtcttgaatgaggattcagggctggctgcctgtgaggatgagacagcagaggctggctctagggagactccctttacagaagtcttacctcattcttcctaagtgggtgggaaagggcattgccaggaagcatgttctgagtggtcttctgggtgcacatacacagtagctgtacacactttttcatatgtcacatgtctcatcagcatctttttttttttttttttgagatggagttttgctctaattgcccatgctagactgtaatggcacgatctggctctctgcaacctctgcctcccagattcaagcaattctcctgcctcagcctccgaagtagctgagattacaggcatgcaccaccacgtccagctaattttgtatttttggtagagactaggtttcaccatgttggccgggctggtctcgaactcctgacctcaggtgatccacccacccaaagtgctgggattacaggtgtgacactgcgcctggcctcattagcgtcttaaatctccaaacgggggtgtgttttttgctattataatgatcaaagggtctatttgaggacagataaaatcaaagtgcacctgctctccagagggggcagtccttactgaagatagcttcccttgaatgagctcaattacaatgcgaatgctgaggcttactgtgttaattgtagggtcaccacgattgctatgtcccgaaaacacggtcacttccctgatacctatcctgcttcaacatcagagagacttttgggagatgcttggcgtgtcccctctgccactgttcctctcgggctccctgggcttctcaggctccgtgagtttccgtgttcttccctaatgtccagaagcctcatgcagaacgtcacccacagctgtgcctccttggtaggattcggtttccagacaccttctcttcctaatgtcacattaaacctctgagaaacacacagaacaccactggctagatgcccaaactgggaatttcagcaaactaaaacttggatagcaaggagaatccacatggtcatccataattagaatactggggatgcaacaatgacaaggactagtttatcacacagcatttaccccacgccaggcacggggctgcggactgcgtatttaccatcctctaacccacagaagcctggctgaggtagggatcgtggttatttgtttttcaccgatggaggggactgagacataattcaataccgaagtgaatattctgtctcaatcatgtacttcaaacatgtttcaccagggagatatctcctcattagagagacctgaaagcgagctaaatgaagagattaaatgcatcttcctggaaggggaaggaaaagccctcctcttgtccctgatcagaagttctctgttagatggctgctgcaagctgtttaaatgattcacgtaagaattgccatgaatgatgtgaaattcaagtgcatgtattatctggggaaataacacttcaaaagagaccacaaaagactatttcattatgtgactgttggtatgcattttaggccttggccagagctagttctgaatacaatctttattcactcctgaatcataccccagaccccctgttcacacagcaacagctttggaaaagagcctgggacgccagaggatccaggggagagtacaaaggcaccatggatattctttcaaaacctgactcaggaatcccattccccctctcacccacccactcagcaaactgaagggagcttttcagatatttccactgcattcggatttctctcccctttcattagaattgagaaaatggaagccaaattgcaaagggatgcaggcatgtttgacgcaaaggcataatttaggtttcaaaataactttaagaaggtcacaggaaaagactttggttccagcaagggcaatctgagaattagtaagctctcacaaataatcactcaatttgcctagtttaagtatgattaagttaaatgacaagaaactaacaaatgccgctggggttctgcaattgccaggtgattcatatgagttagtaggacctaatagctggttgcaagtctatgtcagataaaaaaagaatgactttgcttttcatctagagcagtagtctacaaacatcattaatagtgtgctcccacagtaagaaatgcttgagcgtatagccttcattcatgtttgcacatgtgttgaaaaaaatgtatacgtatgttcctgtatgtgaaacagctggtgacataaattctgacgaatactctctgggcttgaatcccagttcagccacttatttgttgtaggccttggtggttcactaacctaatcatgctttagtttcctcatctataaaatgagaatgataactattagtacactaatagttgttatgagaattaaactacttaatacatataaatcactttgagcagtgcctggcatataatgggttctatagaatgttagcagttattgtagctgtattaatatataaaattgatatattataattaactatatataattatatatgatattataatcattaaatgtaatataatctatataatcataattaatatataacatagatgatatatgctaatatagtttcaatcattgctaacattctgtagcatttgttatatgccacttctccaagtgagatatatgtgtatattttatatatatataaaatatatgtatattttaagatattatatataaattctatattttatatataaaattctatattatatatatccatcccctctgtggtggaaaaggtttcatgtaatcaatctttcaccaggtgaatgactcaatggtcctcctggggaaacttggcatgtaataggtgcagtgttggtctctgccgttgacaagagtagacaagtcagccttcataaggggaagactatattgttgagctttgcataggcttcatccctgctactgtaaacattttatcaatgggcccattgggcaataagtatattatacatatgttttatatataaaatatatatattttactacatacaaaaacagaggttttgaaaggatgagataaacctatacataacttctgatatttttatctagcaccccaatggatggcttaagagcccattagggtgtatacattctagtctagatatcagggaccggcaatcattttctctaaagggtcggatagtaaatatttcagctttgcaggctataacagtctctgtagcaaatactcaattctagtattgtagtacaagagcagccatagacgatttcaaaatgaatgtgcttgggtgtgtgccaataaaactgtgtttataaaaaaacagataaagagtatatatacattcaggtgactttgcaaagaattaaggaagttgaatctagcagataatcccaaggattgactaagctcaattttcccactcatgtccccagcagtgcctggggaagagctcttctctggacttggcttcaaagttcaagcatcccttcaccacagcgctcgccttagaggctgctaagacagaaacccttgaccttgttctccatcagagcatcaaagagccatcattcggactcgaaaaataccagccttccttcatgtattctgtgacaatgattacttcctttccttgcactcctgtactcacttcacttatccaacagtaagactgttgggtttcggttagactagttagaaagtgagctgaggagcacattagttattaaaatgttaggaagcttaaaacaaaacaaaaaaacaaacaaaaaacagaaaaagagacagatctggcccttggatagtttgcccactcccaccctggaggaaagaatgagggcaaatgggtaagaattacagagagccggacccagctctccatgagaaagaacactccagcattgttagctgtctctcattagcaagcttcccagcactgggattatttaagcagaagctggagacttacccccatggataattctgcagcaattctgagttttgtaggtgaaactagacatactttacagatctttctaaatctaagatttaattattgttatcctaagtagtggtgaatgtaggtcatcatatttgttcttggaggtctggaagtgaaatataaaatcattactgtgtctgagaaagtaaagaagaaatcagagcatcaggaacaaagtataagattgagaaaagaaattcacaataaataaacgtaccatttcttaaaagatacattagagtgtttgcataagcaggtgatactagtaagtatatatggcttttcacgatattttctataaaatgaaataggaggtaattttaacctatagcaaaattctaacttataatcagatgttaaagttgcagttttcaatatcaatttgggatccatacatgatcccaaaattaattttgagttcagaattttcactgacagcagcaaaatgctgtaagtgtcttattgggtataataagtaaagtaagaaaatgtgctcccaatttcacaccttggtttccagtccatgcattctgtcttttgggaggagagaattatgtaagagtctcattcaaaagttacgctgaattctggaagacagaagcccatctttttaggatgttgtcttccgcatccttaactgagtcttcagcaagccattccacctgtcagctaggccagctgcttctggaggatagactaggtggcaagacaagttaatgccatgagctaagcccattattatacttctgctgtgaaatgggttcctggagcagaagcagtgctgtgcaaaatagcatcacagtggtgagcacttacgggagcccaaagttgatggtcctggcaaagcattccaggaaggagaggccgacctatatcacagtatatgtctagtgcagtgagtacaagtatccatcccctctgtggtggaagaggttccatgtaatcgatctttcaccaggtgactgactcaatggtcctcctggggaaagttggcctgtaagaggtgcagtgttggtctctgccgttgacaagagtagacaggtcagccttcataaggggaagactatgttgttgagctttgcataggctccatccctgctactgtaaatattttatcaatgggtccattgggcaagaagtggggttgctggagagagaggctgactgatgtttacagagtgtctcattttgtatacctgattatgaagagcctccccctctgcggtccatgcctgtgagtgaacattcacatgcctcgccagcatcttcatggcctgtgcctgttcttaaagcttattctatattcctctctcccagccttccttttcactaaccttccaagtcccatctcttccaaatccctgactgtcaagtcaaaccagcatcagtcacccatgcatctgtgtagatctctacttctggccctctgtcatggcaaagataaaagtggacaatctgacacatgaagttcttccccttggggggattgttttcctcaccattgtcattcaggtttgcccctgagggccctgtaatggggcagctgtctaggttcaggtgacatcagcacgtaatgcaggcctgtctgtaagctaggctgggttttttgccctagatcaataggcgataaaggatgccacaggagggcttggccatgactgaagggaagtcagcaatgctgaaggagctggtgctagaggaatctaaaactcttgctcaggtaatgtatttatctatgctgggtctgtccaagtcagctcttattcaccattcccccttgataagggattactgctgtgcatacccaaccttggcttatgggtcacatagcaccaattggtgatgggaaatttaggcttaatgtcccacagttaggcattcagtctctatccatggccctgagaatgtctgtcttaagaaggatatatatttccagaagtgggaacagatttcatcctaaccctggaggttctccctgtgactctcctattggtgcttgccagtaacaccatacaacatccctatgttccacagacacctcagggaaacaccagatcatgagcccatgtgagggagcagctcacactgcagcctgggcatatgacagagacttcactcactctcctcaccaggcaaaactagcagatttataggagactgtgcaaataggcctaagtaacacactcaactgtgaaaaatactgcctttaaaataaaagaggtctgcaaagagccatgtttttgttcttctctggtgataggtgcaaggaggagcagcaactggtctttctacttagaggtcattgagacctcagaaacatcaccgaggtggcaggcccctggtttgatatgggacgtatcacccgtgctccaggtcaaatatgtcatatggaagtacacgctgctcatcagatctgagctggctaatttgtggactagtgtgatgtttcgtgaaatgtaaagtcaattaagattttagaaactgcatgtcaccagaaagcaggataattggtactgccctaagcaagattgtgaagttgtattattggccctgacagatgaaagcaaactgcttctggtttgtccttctaaaataatatgaaggaaagaaaacattctgcattctgaatgccaggcactgtgttgacttccttcaggaaagatgctacctctgaaacagcacctggaattggaatcaccacctaattgtgtttatgataatctgcagaaactccccatgattcatccaactgctgtacaggctgaacaggtgagttaaatggaggtgtgatagggatcaccacactgcatctttgatggtaacactcaacccagcaatcccccctgcaggaattgcttctggtgtactagcttggtagggaaagaaaattccagtgtcttctacttagtgtttcctataatgggcctcacccttttggctagagaactaatgtggagactctgacagttgccagatatgtctgtcccagttacatgttcaggaactggggaaataaccatacgtgtgtgtgtggattatctgggcccactgcaggttgaatttcagctaatcctccatctctcacctgaccaccataagtaccactctgactggtgaaccactgtagttattcagaattctgccaaccatgcggaagctcaaaatgctgctctcataaacagcttgcaagctggaggaccacctcctatcaatattttacttgctgtctttcaaactgacattagcaagactctagcatataaagcaacagcaggatagaacaaccaaaagggatcttagtccttcacatattaccctttaatttttttcgaaaaaaaaaatggatacttccttttggctcttcaagtcacctcttggtacaaaaaaaaaaaaaaaaaaacaaccctctttctttgagtcttaattttgtagtttaggacgggggaaaaagaatagatcgatttacctgaaaataaatgtcctttggcatcctgtcccacctataatcctatcttttgcagatatagaagcaaaaattgctgttagtgttccaccagaggtctgttgagaggtcatgatggtttcccgagaccggccagtacatcacggggtatgttctcatcaggccgtgagcttgatggtcccttctgcacaacaggctgtgaatgccattccggtttccacaggtaattctaaatgaagacccaaggcttcaacagtgacatttcaatttgtcctctcttgtccacctttctctcaataggtgtctgagatgtgcatatattcatatattctatggcagccttcccatttctcacttttcctaatagagaaaacatttcctttcttcacagcttcaactcaaagctctccctccctgggtaccacctagacaggcccacacactctctccttggcgtcagctttggctctcttgccttctgtcagcatttggcccttggaggaagggaaccagtgcttgtctccaaagatgtaaccatgacaacaagattgtggggtttatctctccagctcctcataaaggctttcctaatttctctggatcttgacatctaggagttgtcccatttggtctgaggaatttttaggctgtctcaatggtacatgaagagtgcccttcatgatacagtggcattttctgaactacaaatactgggtaccattcaagccacatatatcttctcttctccaacctccacctcaaatataactatcaagaaatacagtgcttaattcctttgcagtttttagatgttgcacaggctgtgagcattgactaggtaaattgttccccttctgattataaacttttatgttgttgagacaaagtaaaaagacaacaccgatgtcctttggtaaatattaaccaccaaaattccatttcacctgccattgaaagcattatttgcaatttatgaatggccaaatgtctgccagacattcattattttttgtctgcccagtaatatttcagagaatgtgtttcaatctttgatttcctgatgaggaaattgaggtttaggatattaagtgagttctccaaggttacacgtctggtcaagggcagagctgcaatttttactattatggcctaaaagctctctcttattaaatcagcaattctgggagaaggaagaaacagccaacaagaagggcagaagtgaggtaggcagaggaaatctatttgctaggatgtgggagtaaacgcatcgtgttgagatgtgaaaaaatgttcttctttcttcatctaaccttgctgtgaattgctgagcacaatgtctccctgtagtaaacaaatggtgatgcccaagattgactgtctgatttaactctcacaactgtttctgtccccatttttaccatgaagtaaacagttttaaagagattaagtaatgttcccaaactggtaacacttctctatcatgaagacaggattagaaactgctgctataacataggcaacctcaatgcgtctcaactgcttattcatgtccatatccagtggatcaagtagtgtctcacgctgacatctgctggcaccaaccacaaactggcttcctgtttagagatgtcagtctcactatggtgccgcataagtctgtgttgactgtgcaatggccttgctgactttccttgtggtctctgctaccctgcctttgaccttcatcttcttatgacttgtttgcctactccttctgccacacccaccaggccagccctcccaaatccacttaattattgtcccaccacttaccatctgcacgtatggtccttcactctctcttgcgtatctcctgtcatctcctgggttcctccagtggctgcagtacccccaggtctgccgtctcacagcagctgtgtggagcctctcaattacacaacccaattacacagcccagcagtgctttcccaggcccgcaggctggcccatgtgggtttcaacactttttccagcattagaattcatgatcccagatcaaacacatttatatcttgcaggtttattttgtttcagtttttggaaagtaatcatcatggaccatttttcggtagtggttattgcccattgtatctatgtggcatcatttcctgccccgccatctgggtgaggcaagcacagagaacagatatgacaaagagtcagagctaggagaaaatttagatgaattttttcaagttcctatttttatagatgagaaaatacaaatgacttgtccaaatgcatgcaactgatttttaggaagcttaacttgaaccttgatagcctgcattttggtctggcatgaagtctggtaccatttattgatcagtctttggagaaaaaatgaattctagaagcttcatttcaataactagtgtgatttcatgaagaacgggttatgcttcaccagcttgttaagaattctttgaattttactgtcacttaatgcaactgcaatgaaattgtacataatacagcagcagggcattcgtactgttttgtaacaaagtttcttggtgtcaaattaaactttattcaaagggcaaaggaatgcagtattagccaaatgcaagaaagtcaagtaatcctgtaaacaagcatggagttatagaacctagaagcagacattcctggttctggaaaagatattcaaagtcttattcccagcccccacattttacagttacgtgtcttcaggattcacacccaggactagaaaaggcgcctactccaagggctctttcgatccaagggttttttgtttcgttttgttttctttaaacacatttctcataggctcagcagaagtctttgtacaggatgtcctaccgtcatcgttaatattaaagaggtgaataatgatactgagagcaagcttttttgggtcagtaaattatactaaacagtgtaacttcagcaaacaatgatagcaagactagaaagggacctggtagcatcactccagggtagcagaagtgattaagtatcgataggagggaacaacttcctactgaacaaagaacaaaaataaaatgcaaaggaatccacaaatgtcttgtggtttacccagaaaaaaaaatacttgatcaaaatctcttattttacagatgaaggcaggggcctcagctggctgtgattcacccaagttctcatggctattataaagtattgctgagcaggtggcaattttagatttgacagagatacagataaatagactcagaaatggacttttctgacaatcacctgcttctcaagggctaggcttgtgtaactagctctaataaatcccaggctgctatctcatgggaatctgtcattataccacccaactggcttgtctttacccagctctcaatcccccaatacctgctcccccatgttttaaacagccagtactaacagtgttagtctttctataacgtcagaaagatctctccagtgagaagcacaagatattatttcttctgaaaccagcccagcgctctttgtaccatgacaaacgctcttctgccatatgcctcttcatacctgcattagtatgccagggctgacatgagaaatgaccacatactgagtggctgaaaacaacaggatttttttttgtctcaaagtcctgaaggctagaagtatgaaatcaaggtcttggcagggccttgctctctgtgaagcatgtaagggagcatctgtttttgcctcttccagctcctggtgctgccggcaatccatggtgtttctcggcttgtagatgcgtcactccaattttgcgtctatcatcacatgaaactccatgagtcgacctcctcttcttataaggataccagtcatattggattaagggctcgtcttactctaagatgatctgatcttaatgcagtcaccctatttctaaatgaggtggcattctaagacactggcgattagttaggactttgtgtatatgttgggggacacgattcaacccatagcaatgccccaagtctttggggactccttcacccgtagctgggtctggctatgctgaactgctccttctccatgcatccgtgtcttcttaagatatttagcttaccaatcccattaaaaaagtgggcaaaggatatgaacagacacttctcaaaagaacacatttatgcggcccacaaacacatgagggaaaagctcagcatcactgatcattagagaaatgcacatcaaaaccacaatgagataccatctcacgccagtcagaatggcgattattaaaaagtcaagaaacaacagatgctggcaaaattgtggagaaacagtaacacttttacactgttggtgggaatgtaaattagttcaaccattgtggaagagagtgtggacattcatgaaagacctagaacagaaataccatttgacccagtcatcccattactggttatatacccaaaggaatataaatcattctattataaagatacattcatgtgtatgttcattacagcactattcacaatagcaaagacatggaataaacccaaacgcccatcaatgatagactggataaagaaaatgtggtacatacacaccatggaatactatgcagccataaaaaggaatgcgatcatgtcctttacagggacatggatggagctggaagccattctcctcagcaaactactgcaggaacagaaaaccaaacaccacatgttctcacttatacgtgggggctggacaatgagaacacatggacacagggaggagaacaacacacactggggcctgtcagggggtcaggttgcaggagaacatcaggataaatagctaatgcatgctgggcttaatacctaggtgatgggttggtaggtgcagcaaaccaccatggcacacatttacctatgtaacaaacctgcacgtcctgcacaggtatcccggaatttaaattgaattaaattaaatttttaaaaaatatgttcagtttactgtctcatctcatctaacagtttttgttgttattgttgctgctgttgttattgttgtttgagacagggtgtagctctgtctcccaggctggagtgcagtggtgcaatctcggctcactgcaacctccgcctcccaagttcaagcgattctcctgccttagcctcccaagtagctgggattacaggtgtgcgataccatgcctggctaatttttgcatttttagtagagatggggttttgccatgttggcctggctgatcttgaactcctgacctcaggtgatccgcctgcctccgccttccaaagtgctaggattacaggcatgagccaccgcacccagtcaacagtttttaatgatcctttagtcataacccttttgacttgaaaaattagtatagtccagaaccttttgggttgaaaaactggtatattccagaagtatcttttctacagggcagcacagagaagggtccaggtagttttaatagataaacttatgcaaatttgtagcacatgaagctattgctctttccagaaatatgttcaagtctcctgaagttccattaaagaggcaacagctatggagctgcagttatccttgcttattggttccttctcactgttcaggacatctgccccctgactcctttcatttcagctccccacagcacagcttacattcataggccgggtactgtgtgccaggaactgtggtaagggatggaaattgaaagataatttcaactccaccataactctcagggagctcacaatctagaagaaaagttacctaactatatgcaatgtgatacagttataataccacgggcatagcgtttacaaaggaagtactagaggacccagggtattgaaggattgattgtgcattcagagataagaaagaaaaagtggacaaaggccattttatttggatcttaaagagtagacaggaggagtgagaggaggaacattcagtttcagtcatgagggcatagccagtgtctgatctactctttttccataaatgattatgaaagctggattaaatatgtaaaacagctgttttcaggacttggtcaacacccaacagagggctacaattcttgagagaaagcaagcacaagaaataagccccatattgactccagcttccaggtgcaggagaacagtgcccaaagaggaaagggcagatcaccaggtaggagaaccatcagtgttcaatgctgctaagagggctgaacttggcaggcaggtgattggcaaggagggaactgcagagggaatcccaaacacctgcaaacatattccctgagatccttggtgattctcaagctacgaattcacaagaagactcagaaagaatagcaaagaacaattgcatagaacctaagaggtgagcagagatgagacatcccaatgttggggagaagttggaatctgtaactagccagagactagagacactggtggattatttgattgtgaccctagaaatgtcaatccttaaggaaaggtgtaaaactaagctgaacacattttttaaagccaaaaaccaagcctctataggataaaagttatatgcttttaagtattttaactgccttccaaaataaaattcaatactcttcagaggaaaataacttcatacagaccctccacaaaatagaatccaccatctacagctaccaataaaaaattactgggtatgaaaattagcagaaaaaaaaggtggcttataataaagagataatagagttacttaaatagaccaagatttgatagtttgtatagattttattggcctgactttgattctctcatcttttcttctgatgttaaacccgtccaattaatttgtcttttcagatattttttactattcaattttagattttacatttggtagtttcctttatcttgtttttttgtgtgtgtgtcttgctgaaatgtgccatctttttgccttaattgatcgtcttacattaaatttttcaacatattaatatttaaaataattgttacaagtccttgtctgctaattccaaaacttgggccatcgccgcttctattgccatatatgttcttttgatcatgggtcacattttttggcttcttcatattgcacacatatttttattgcatgcaggatattgtgcaaaaaaaaaaaaaaaaaagaacagcagaaattgaagtgcagaatattttcccctagtaaaagctcactttttcctctgttagacaattagactaaggctctgttttctccaagctagtgactagttgatgtgggttgggtctgggtagtctttaatgacttccaccacaagtgggttcagacgtagactctttttcttccttgagcacttctgtacctacactcctcatgatcatgcgatcacccaggccccagcttcctgctctacaacttattcagcaaaaacttgtggtgtcaaattgtcaagtcatagacacttttctgtatttggagctccctcccatgtagagaatgaggcttctttcttctttttccagcaacagtccactgcctaattaatgctcctccatggctgcgcttccaggattggcaaatgcccacagggatgaaagtggttcctagggccttcctaggaaggctttgttcctgtctggaagttaggatttttctgtttctctgcatccagtgctctttacataaaatttgcgaacttacttatgttttctttcttttcttttctttttttttttttttttgagaccgagttttcttctgtcacccaggctggaatgcagtggcacgatctctgcttactgcaacatccacctcccaggttcaagtaactctcctgcctcagcctcttgagtagctggcattacagctgtgtgccaccatgccggctaattcttgtatttttagtagagatggggtttcaccatgttggacaggccacttgagatcactcctgacctcaagtgatctgcctgcctcggcctcccaacgtgctgggattataggtatgagccaccgtgcccagcctgttttcttgatgttatagcaagacctgtgatcttctatgattttccacatcctcattagatagtaagacttacctggtagtgtattaacttaagaatattgagattctcaaattcttcttcaattttctccaataaatagaatggctatatatggaagattagctaaaattgtatactcagaaattttacccctctgcctatacatatgtgtgtacatatttatctagtatgtttgtgtgcatgtgaattgtgattgaaagcatgattagaacatataagcttttcccagcctcatccacctctagtcccctctgctgcttgccttaccaattagcattgagccaccattatatcatggctcatgaggaagtcaaaccccattcacttcctactcatcttcttctagtagtttctcctagtgcaggttagaagactagaaaacctgcttttttctatctccctggaggtaagcaggaaggtcctgatgggcccatacagttttgctgcatgagattaacccacaaaatgcccagaaattcaaaacatagttacggatttgctgagtagctgctgaaatggtgaggttatgcaacctggaaacatggagctgttaacttgttgggattcactcaggatggtggcggaaatattaaagggaaatattagggcaagttatagggaatagtcatgaaccttttggaaggccgaaaggttacatagcttgtaataattgaacaggctaaaggcagccagttcttaccttagagtattaggtcacagggtaagtacgaaggacaatagaggcttccccagttaagtctgtttaccctgcctccattaactaatctttgagccagatgaacctcttacagggaggtcgactagggatattgccccctaatggtatttaccttagacctcggtacctgagctttaatcattcctagaactactctctgaaccatgttaattatccacaagtgtgtttactcaaagcttctgttgttaattgtataccaaataaatgcctggagtgcgagctgctcagggccagtgcagtgacaaacctctcttggtgtgcaggtggtcggacactcagctggactggcaaagcagaatatctgtgtgtcagtgtacattttattcatccttcatttgggtcagggtctgcaggcagcccccccacagctaatgtcctcttgtgaggagcaatacctcattaattcatgtggagaaaagcttcaatcaatggcagggagaaagtagacacataccttcaccttccttttgatggactttccaaagcatggttctgcataaactctgttagcagatatggctgactgctgagggggtccacctgtagaacaactgacagtatctctttatggaattgtcatgaagctgtgataagcatggtatttgtattagtctgttttcacactgctgataaagacatacctgagactgggcaatttacaaaagaaagaggtttaatggacttacagttccacatggctgggtaggcctcataatcatggtggaaggcaaggaggagcaagtcacatattatatggatggcagcaggcaaagagtgagcttgtgcagggaaactccccttataaaaccatcagatctcatgagactaatttactatcatgagaacagcacggcaaagacctgcccccatgattcaattacctcccactgggcccctcccacaacacgtgggaattcaagatgagatttgggtgggagcacagccaaaccatatcagtactgcattacttgcattgctttccatcatttcttcacagcctccattttctctcactcttagattgctccttcgaaacaaaactttgctggttaattttttttgtctgggtctgatctctgggaaagctgagttaagacaatctgaatcatgcatctcaaactcatgcaatgggaggaaagggagtacaaacaaattgaattactcttgatattagtagaaaatatctgtgtttataagtaaagtacagtttgcttgcctagagttgtttcaaccttttcatatggaaagagcacctcccatccctaggagaataagaaaccattccacttacaatctctacacttttaaggttctgaatgataacggtatctgaatatccaaacatgacatttcatcagaaagtagaatttgctttttttttacttattatttttattttctgatccactgactttctgaatatcaaccaccattcatcaacaagtaggtgaagatatcccaacaacagattcccaaggaaaggctttgaatcaagaaactgccattaaatagctgtatggctgcacaatttaagtaacctttctgaacctcaactttctcatcagataaaataaagactaaatgagatgagcatgggcacgcacctcactctgagccgggcacttactaggcacacagcaatgttcatctaatctgaaactttgtgttatttcaaacaaattactttgcttgatattgcttttagaagaatgtcctattccacctccggatgctaattgccttttcagattatgtatctcattaagctgtgtatatcttcatgttttagattcagtagtaattgagtgctcagtcattgctatattcactatcctgacaacatttattaaaatgaagcaattaactattgtcttaaatggagtttagaggtaaggctcattagacttaggctcattacaattaacttaagtgttaaatgcaaaattattttatcccaactttaccctgaaaatgtattcaaatggatttctctagagctggcattccttcgtcacataagcgcaaaactagttagaaatatttcagtgaaacacaatcttcattaaaaagatattattaaaaatgtaaagccccaaatttgctcacaggggttcctgctctgttaacatctgaacccaggcacaccttgcttcacgggctgccacataattggactcagaggctcactaaagttgaggtaaagaaggaagcaggcctggttttaaatggctcaatcctttatttgtattcagtttcacaggagatgagccccctttgcctacacaatggtaagaatgacaatgcagaagagaggctcctcttcctatggatttgcttcaaggaggtcagggctgtcagtggtaagtgattttctactgggttcatcagttattgtacaaaagtgtggctttcctagctctcttgccagactacagacattagacagaaggtttagaaattttattttatttttccaacagttttgtgaaaagaaaatagaagcaaagaagaatcctgtctagctgcatccaaaccccttttcccaacataatgcaacagatacgaattttgtggaaagcaccatttaaggggctgtgccaaggggtggcgtgggagtcaggcaggactgtgtttcactcctggttgcaccagtgattacctgtgggatcttccagacatatatagcctcacaaaatctcattttgtgatttaaaaaataaaatcatgccttttttttttttttttttttttgagatggagtcttactctgtcacccaggctggagtgcagtggtgcaatctcagctcactgcaacctccgtctcccgggttcaagcaattctcccacctcagcctcccgagtagctgggactacaggtgcccaccaccacgctgggctaatttttgtatttttagtggagatgggttgtcaccatgttggccaggctggtctcaaactcctgacctcaagcgatccacccaccttggcttcccaaggtgctgggattacaggtgtgagccactccacctggcctgcttattctttccaagtgtggaaataggagagataatattgaaacccttaacacaatcttagtcacatcatgcacgatggataaatgttccttttacccttggcttctgtgggttcatcagccatatggtataatttggaaggtaaaacatggatatcaaaccctatactagaatgtctggcatatgtcagtagcacctagaatattttgtttgcctctctcatgtggataattaagtgttccagttttcaatacagagtataaggcctcttcagcataatctctccaataattaaatggcaacttgaaatatgtaataaaagagttttctaaattactatgatttgattttgacctaaaggaagtaatgtaagaaaaaagaaaaaacattttaaccacaaagctgaacatgaaacaggctgcggaggcagctttttgtgggcgtgggaaatgagcatgggggaagtgaaatgtatcaggtcataggtactattctacctattacagcacccaagagaatttaaaatgtatattgacacaaaaaacctgtacaactcttcatagcagagttatccatagtagcaaataggtggaaacagtctatgtctgtattagtccgggttctctagagggacaggactaataggataaatgtatatatgaaatggagtttattaaggagaattgactcatacgatcacaaggtgaagtgtcacgataggccgtctgcaaggtgaggagcaaggaagccagtggtggatcagtctgagtcccaaaacctcaaaagtagggaagccgacagtgcagccttcagtctgtggccaaaggcccgacagcccctggcaaaccctggtgtaagtccaagagtccaaaagctgaagaacttggagtctgacctttgaggacaggaagcatccagcacaggagacagatgaaggccagaagactcagcaagtccagtccttccaacttctgtctgctttattctggccacactggcagtgattagatggtgcccacctagactgagggttggtctgcttctcccagtccattgactcaaatgctgatctcctttggcaacaccctcacagacacaccaggatcaatattttgcatccttcaatccaatcaagttgacactcaatattaaccaacacaatgtctgtcagctgacagagggatactcattagttatttttcctgatcctctcactcctcccaccctccaccctctgatggaacccagtttgtgttgttcaacccaggaacaatactttgcatccttcaatccaatcaagttaacactcaatattaagtaagtaaatattgagtatttaaataaaagaagccagtcaaaaaaggccatatgttgtacaattttatttctatgcactgtttaggccactgaactgataggggaaagatattagtggtagccaagtattgaggggaaggagatcctggatagtgactactactgaatatggggttttattggagggggaatgaaaatgtcctgaaattagtgatgatggttgcatgactctgaatatactaaaaaccactaaattatacactttatgttatgtagattgtatctgttatttaagaaaatatggcccgggtgcagtgactcacgcctgtaatcccagcactttgggaggccaaggcgggtggatcacctaaggtcgggagttcaagaccagcctgactaacatggagaaaccctgtctctactaaaaaaaaaaaaaaaaaaaaaaaaaaagttatctgggcgtggtggcacatgcctgtaatgccagctactctggagactgaagcaggcgaatcgcttgaatccaggaggcagaggttgtggtgagccaagaatgcgccattgcaccattgcactctagcctgggcaacaagagtgaaactccatctcaaaaaaaaaaaaatatgaaaactttgagagaacttgcagactaaattctgattgaataccccagacaacacattctcagagaaccactgaaaatgctcattaaagattcatttttcatcagtctattgagatttgtcatttgtagtttgtttcttgagtcaaggagagaccatgttgcagaattcaagaacatatattttttaagtcaagcaagcctcagttcaaattccagctcagctcttactaaccaagtacctctgggcaagttattttgcatttgcagtctgtttcctcattctaatgtgaaaataactgtaaaaagaaaagaaaaaaaaaacctccttcatgaaggtgttgtgaggattaagtaaaaacatatttggaacatatgctctcattagggatgacactgtactgcccccaacagggtgaaaattggctcttggagggggcaaaaatttctgttattatgtgttttgtccctccaaaactagccccactgacaaagtcttattccttagtatttaatgtgatgaagttggagaaacaattaggaaaaaattatctaaaaagactccttagggaggcgattttttaaaaaaggttgtagcgcttctttcctcattagttgattggctcaatagaaacccttaaaatcactatttttcatcacagcggtgttttcttctttgttcttaagttgaaacaaatctctgtccaaagttactagctgctggcctgtttgaggaataaagagcattctgccagcaacccaaatcctgtatttccagcaaagtgacatttgactcaaaaaggggtcaaagcaacaaagaaagcaaatccatataatttgtatggctcttctaattttctatcaggtccgtgagccctctggtttcttcagctgaaaggttcactgtgccacgtctgtggcccctaaactgccctgccccagcttgaactggcccaggtaagtgactgctgagggagatactattcagcctgattgcaacatggagcctggacctgaagcagaagcaggtgtgcttgtgacatgagaggggggcacggaagtgctaaatagagaagggcggggtccctggcgagagctccacctggggcctgggcccgcagacctaagtgaggccaggcactcctgtttccacacccaaatattgcatcttccaagaccactccggcctgccatgtccccatcctgtgcctatagaaatcccgagatcctagcgggcacacacacacaggcgctggacgttgagaggagcagaggagtggaagagcacaccgacaggcaccagcagactctggcaggtcatcgatggcaggagggcatggaattcagccaggggcggttagaggagtgtccagccactaggcggcccaactccagggaagacccctttccaacaccatcccccttctggcctccccatgtacccttgcgagctacctccgctcaataagaccttgcactcattctccaagcccacatgtgatctgatttttccggtacactagggcaagaacctgggatacagaaagccctctgtccttgcgattaggcagagggtctaattgagctgatgaacgcaagccacctgcagacggctaagctgaaagagcacacatgcccactggggcttcgggagctgtaaacactcaatcctagacgctgccatggggttccagcccaaagactctccccatgacctgcccgtctgtatgcttcccctacagatttgagcagctgggcaccaaagaagggagccacacctcctatggtatgccctatgagtggaataagggaaaactcctcccgtttcacttagtgccctaatttcccttcctgctgcctctgtccatattcagggtcttcagggcactagctctttcccaccagtctcccaattagcctttattcctagctcagcaaagtttatgcttaggatggtaaattctaaggatggaatacatgcatcaaacactaagaaagtgaagcctgttggcagggattggattcttatctagttaagtattcacttgtgtaaatccaaacctcatggacattttcagaatcaacatcttttttttttttttttctgagatgtagttttgctcttgttgcccaggctggagtgcaatggtaaatcttggttcacagcaacctccgccccccaagttcaagctattttcatgcctcagcctcccaagtagctgggattacaggcatacgccaccatgtccagctaatttttgttttttttagtagatacagggttttactatgttggtcaggctggtctcgaactcctgaccacaggtgatccacccatctcagccagaataaaaatcttaatgatcactaatcaattcattgccttaacaacttacctccaagaacaacataaatttgctttaaacatggactgtggtaaagatgtttgcatcttctaattaagctgtgtttcattcagcaaatctgttttgagccgtagctgcgtgtcagctttattccaggcactagggatacagagatgtcaaggacaagacaaatacgtcattggctttatgggacttacatttcagtgtgttgtggggtagggctatgtgggtgtgggtgtgtgatttgcactctcagctatgccctagttattcttactgcttcaggaaaaggaccgcacattttatggaataaataacaataaaatatgtcaattatggagtgtatatcaagtgcaatgatctatgctagttgctttcaatctgttattttattaattattgtaacaattcaaatctttggcataaattttgtatcattaacacattagacaacagtcgccgaaatgttcactaaacttcccaaggtcagcaccaagtgagtggctgagtgagatggtgaatgatcagctctgtcccacttccatgaacctctgaacaatggacacgtgaagtttctgtgggacttgaagaaacaaagtgagtgaaaacgagtttcacctctttcacaatccaacacgccacccccaactccccgccactgacaaccagaggctggcaatttttgagttgggcattttctcaacagttgagcaggagtgtgatattcccagagagatggaattgggggctgtgcacaccgcagctgcgggccccaggaaggacagatggtccatgccgtacgctgtctgcttgtacagctcagcaaatacattttccttgactttaattgcacccggcagacagggacaaatacatttgctttgcttttaacaatactttggtggtatctggagcatgcatgagcatggcagttaaatgttcctctattcgctgctctgaaaagggagcctacggcttggttgctttctcagtctcttctctctctctcccccttcatatatatatatataaaatatatatatattatatatataaaatatatatatattatatatataaaatatatatattatatatataaaatatatatattatatatataaaatatatatatattatatataaaatatatatattatatatatataaaatatatatataatatatatataaaatatatataatatatatataaatatatatattatatatataaaatatataaatatatatatattatatatataaaatatatataatatatataaaatatatatatattatatatataaaatatatatatattatatatataacatatatatgtgtgcacatcctggtgtatataatttagcttctcttcctctctgagattggtaatttttttatttttctaatttttattctggtataattaaaatgtagcagatattacatttaagagttccatgtgctttgcagatgtccatctaatcaccaccaaaacaacatgtaaagcatttccatgaccccagggaatttctccatcaccctttctggccaattcttctcaactcctaaaagcaaccactttttgatttccatcatcataaatagcttttgctcttggaattcaatataaatagaatcatacaactttgtgtctggctttcttgggtccgtaaaatatttttgagattcaccaccgatggtgcttaaattgatagttcattccctttattggctgtgatatatttcagtgtataaatagtcaacattttaaatctattttcctgttaatgggcatttgggttgttttctgtttggggctcttttgacgaaaactacaacacacatttgtatacaagtgatacttgaggacactcatttttcatgaatttattgagaagcaattgacacaatacaatgaaatatttcagatgtataattagaccaaatttgacaaataaaaccatcacgacaatccaaataatgaacttatccaccactccacccaaagtttcctgtggttccttgcagtctccatctccctgttttgacctgcaccatccacagtcaaccactgaatggctttgtgccaccatagattcacgtaaatattctggaatataaaaaggaatcataggccggttgtggtggctcactcctgtaatctcagcattttgggagggcaaggcaggcagattgcttgagctcaggaggtcaagaccagcccgggcaacatgacgaaacctcatctctacaaaaaattcaaaaattagctgggtgtggtcactcatgcctgtggtcccagctactcaggaggctgaggtgggaggatcatttgagcccaggaggtcgaggatacagtgagctgagatcacatcactgcactccagccttagtgacacagctagaccctgtctccaaaaaaggggggcagagggtgaattatagactattgttttatcagccttcttttattgagcctgataatgttgagacttaaaaaggttattgtgtccataaattgttctttctttttccttgtgaagcagtattctactgtgggattataatgtttctgtttttctttttaaaactttttaaactttttttgctaaggaaatgctggtgttatttttacttcaaagataatcacaatgaacacaaacattttagcggatgatgttggaaagcctgcctggagaaagaccagcagcgcaggcttcattttaatcaccaaatacatcaatattggcaaaagaaagcttttagattgctaaattattcttccttgcattgtcaactggaagctagggttctttctggtgagtcaaatgaatagtatcaccattatcatcctcattgatcctcacccatgatgtgggccgtgatgaagccaagctcaaggggcagctagcattcagtatcggaggagcagaggccccgcagctggaatcatttcaggatctgagacatgctcaataggtgaagcctcagacaaatgctggggtcaggagaggagacgccaggagactagtgggttgaatgcagagttggagttgtggtgtgaagatagtcagaggatatgtgtgtctgtgtctgtgtgtatgtgagagagagcgtgtgtttgtcttaggaagcgtgtgctcctttgccttgtatatgatcttacctggctccgtgatattcctacaaagccttttgcaggaactgcatttgtctcacacctcacaggctgcaaggccttatcccaggtgaaatttaatttgacactgtaaagacttaaaaagagctatgattgttagcaccatttttacagatgagaaaactaagaaatatgggaagatattaataaaagtcatctatttatttgaagatattcacagtgaagactagagcccaggcatttgggcatcttgtctggagcttttctcccttttccctacagcactgtcctccatacaatggtgtgaggcttaagcacacccagaaagacccagtggtcatctacagggtatgattttagagaagtataggaaagcctccatcacccatctagtaccagctctgctacttaagaactgtcatataaagtgaaaagaggaccactgggtatagtggttaaatatacccacaatctgttcattagccagttttgtcttcctagatttgcaaagggagaaggtagaaaccgcaaaatgctcttttatcctcctcttttcccaaaatgagtggcataatcacaaggaagcccctgtacacagaaatatatatgccagaatgctcaggactcagatatatgactctatgaatggatggatggatggatggacgaatggatggatggacgaatggatggatggagatatggttcggctgtgtccccactcaaatttcaccttgaattgtaataatccccatgtgtcaagggcggggccagatggagataattgaatcatatgggtggtttcccccatactgttctcatggttgtgaataagtctcatgagatctgatggttttataaatgtgaattcctttgcacaagttctcttgcctgtcaccatgtaagatgtggctttgttcttcatttgctttctgccatgattgtgaggcctccccaagcatgtagaactgtgagtcaattaaacctctttcctttctaaattgcctggtctcaggtgggtctttattagcagcatgagaacagactaatacagatagatatgtaggtaggtaggtagatagatagacagacagatgatagacaaatagataacagatagatgataaatagatagatgataaataatagataaatagatagttaatagattgatagaaaaataggtagacagatgatagatggatagatgataggtagtttgataatagataataatacatagattaggtagatagacagatgatagacagataaacagataatagatggatagatagatgataaataggtgataaataatgaatagatagctaataggttgatagaaaaataggtagacagactgataggtgatggctagatagatgacagacagatttataatagataatacatagattagatagatagatagatagttgagagatagatagatagagatagacagacagatgttggtgtggattcagctggttctggggtgaagggttctggaccagctgtttgctgctaacccaaaggtcatgactagagctatgtgtaagctaacaagtgcttgggtatctgtggacacaagggacacatgaggacataagcacctgggaacagctaagagaaggcagtggatattgaaatgactttatcatatttatggagagctcctttgctgaagtatgctctcaattctgttcctccaggagtcttcattttaaacaagatttcaaggtagttgggatgttattattgttccacatgtcaacaactcttgacgggttcatttatattttaccatagagatatctgtgaagccctattaggctgcagctaaaagacatttttcttcctgtttctttcctccattcactgaactgacatattgtgttttgttctgtattatcttttggtgctttatggaaaaatgtccacatttctcatgcagctaccccaaggtatttcttgtgagaaaaagaaaaatatgactctttttatgagaagagaaacggtttccccactctttccaattgtgtattcatttcaataagcctggatcacttgacagaagggacttcaaagttgatgatgatgatgaattacaaaactaaataagaagtttggaagaacagggacaaatctactcttggccatgcatggtggcttatgcctatattcccagcactttgggacactgaggtggtcaggatcatttgagcccaggagttcaagaccagcctgggcaaaatgtcaaaaccccattgctaccaaaaatacaaaaattagctgggtatggtggcgtgcacctgtagtctcaactacctggagaggctgacatgggaagatcacctgagcccatggaggtagaggctgcagtgagccctgatggtgcctctgcactccagcctgggcaacagagtaagagcctgtctcaaaacaaaacaaaaaaaaacaaaaaaatatattctcatgaagtttgtaatggctgtgacctggtagaaatgcataaatagactatctattttcacaaagaccatattaccatataacttagcaggtatattggagtttaagaaatagctagaattaaattatttcaaaatcaatttcaaaattcacctttgtgaaatttagaaactttgtcataaaatcattgcatttctaagctaaaagaatccaagacaagtgatgtcattcatgtaggtgtctccatcaatccaacagtggatcatttgagcagcattttccctgtgtatgatacaagcaaattaataagcatgaaccctgccctgcaacttgtacccaaggctcaagcttaggaaaccaaggagggagaccataacacagtacctgcatgtaaatggcatccagtttcagaaaaggaaggaatctgagctggagggctgcatggaaggggtggaatttaacgttggctttgaaaatcacataacatttgaaaaggtggaaccaaatgtgaagatttgaggcactggggcttctgtgagcaagccacagaggcaggaataagcacagttcacagccaggggagaatgtagggccaccacataggagatggagctgactcttgacttcagttttctgatccaggagtgtaatatacctcaagtagtcaaagattggaaaaatacttgactccttcaagacagaatccaatggggaaaacacatctataaacagcttatcgcatatgaggtaaccccggtggctatgtatggctccctgatgtcgagagcagtgcgtgcgtgagttttctcctgctcctttcctctctcctgaggctgaaagctgcacaccctctgtgtgattcccctcagcaagtatgctcattcatgccagtctgtggatgtctgagaatgtcttgatacacaaccatccttaggggtaactgaaattaactgggcatgttgctcttaaaagtcggataaggagtacaacagtataggtcagaaactttggagatatagaggctaccttcccaaggcctgctgtgcctagacacaggatgaccattctcagagaagaaaccctaaaatgacaggaacgaggcttttgtgtctgcacctcaagttctctattcttcttttcttagactggaaatcccagctgcttcttttttctttactgctgttactttccccatatttcatctctcccgagatgttttatgcattgtgggaaacgtgcacagctgctgcacctgcacatttggctcttcccttcatctatacttcaccaaccattcaggtctccgtctaacggtagatttgccattgatcccttgtgaaacattatatctgtacatatttatgtgttctatattttgagttacagaattaggtggatacctttaaaattgctatttcttcttagggaagcaaactactaacctataatcattatttttatttttaaaatgcttcccttcttgtattttctctggtggtactgtagtttatagcttctccagtcatatatattgctatattaatagcattgcctaagtaaaaacaaaacagtatttgtctgatatctttttaaaatgtttcattaatttctccaacattattgaggtataattgccaaaaaattttgtttatatgtacagtgtacaacatataccatgatgtttttccatcctttgactttcaagttttctgtgttcttatgatttatgtcttttaactgaagaattttggccagcattctggtcactgatatgattgaattcatttcttctgtactaatttttctttgtatttgtgcccttttttctcctgtttttttttttttcttcctgttttggaatgattaaggtctgtttttcttgctggcattcttttagttccattttcccctctactagtttggatgttactctttctatatctttccctatctctaagaattttaacatgtagacctttaaaaagtgtaagggatgaccaatgtttacaacttagacacattataatgctttaacttgggtcactcattcctaactatcctaacccttgtattattgtttctaacctccaaggacacatttttttaaaaacacacttactgctttttttagatttctctgtgtgccattttctttccttactattattttcacatctcaactctgtcactgttttctttatttctgaaacacaactttttgaacactgatatttaatgtgtggtctgtatattagcactggtctgtaaattgttacttactgctccgaatctaataagcagattgatccaaatgcaaattagctacctcattaagaacgctttattgcaggggacatgtttttcacagcaagactttctcaatgaaagaggcagtctgttgatttgcattccctcagggttttgttgttgtttttaaatgtttttattttgttttcattctggaaaaatggttttgtgggataataatcagttaagaaatcttccctttctatttgctggttatgttgttgagaaagtagctcttaagctaatgatcatttctttgcagatattctgtctttttccctctgaaaggcaaagactgtttgtccacgttgttcttcgttttcagtctcatatttctaggtatagatttctttttatttctcctgcataggattcactgggatttctgaatctgaagattggcttttgaacaatcatagacaattccctttcatagtctcctcaaatagtgtctcttttccacatcctgtgttgtctctttctgatacttcaaagggattaatttgagacttcttacttaatcctctctgtttctttacctgtcttaaacttggtagttctctaagcggcaacattgtactttctccagatctattttccaggccaacaattctcttaatagcatcatggctagaaagaagtatagataaaatagaaagacagaaacgatgattagatagacagacagatggattcttacaggaaatatgaggtctccagataagagaacagtctttattactcacagaacatcttggccccagatcgccactggactatacatatgtttctgctttaaattgtataggtgaatatatgggggacatatgttcacctgtacaatttgtggactcctgtggccatattaaattatcatcatttctttaatgtgctcatctcttccgacttcctactgttttctctaaataggaagcctccatacctctcttcatttagacagagtcttctagttcgttacatctcatcttacttcaagtaccacacccgataggaagtcttctttgaacgtctttgctgctttagcaacctgtacttatctctctcaaggcattcatcacacagttttttaatgaacagattattgtttgtctcttttatttcactttcaagcccttgggggcaagatatcttttttattcttatttcgcaatacctatctgaaatcctggtacatagtaattttcagtgttttcctactactctaatcaaataatcattgctctccagttttccatttattattattattttgtaagattatattagaatcataaaatgttagatgtagatggaaacctaggggacatctattttacatgatataaaattgctatcagtattttttctttgttttaacgactgacatcagttgggaaactcttagccccgccttatctcacatctcctggatcagcataagtttatgtgcctaaaatctcatttcatgggagaaaggaaaatgggtatcttgcagcaagaatgtaaggggaggacaatgtcactgggtaagcaaaacagagtttgtaaatttatcagtacttcttcccacccagaaaaggctcagtttagagaaaaaaaaagttacagacatttctattttcaacattttccctaacatccagtactgagttccaccagctatgtctaagttgacaaggcagcaacttcagttcatttgttcaagtgtactttgatttgcatagtttcataacctgttagcatctgctcattgataattctgagcttgtgctttcctgacgattttttactgcagaggtggaaaagtactaaacggcaatttgtttctttaattttcctgtgcaaacaaagtcagggaacaaagaaagatgcatggtgactgcaaaatatcattattattttatcaacaatgataatacaatactccatgagtacaacttcttagtaataaatgcacataaaagcaagatagccaggaagtgcaaaggacaaattcccataatgctacatgaattgttttgcatagggcccactgtagcctcctgctgcctaatagataaattgaaaattttgcaactctacatctatctcaccagctttcagactgtgcactagctatgccaaattgactaatgtggatcgagactaattataaacataagtagaattcctagtacacctgtgataagatttcaggagctagtacttcagtatatgacattaggggccactgtcagcaatttctttagaaggaaaataagatctcactgggactctaaaggtacagtttatttatttatttatttatttatgagatggagtcttgctctgttgtccaggctagagtgtaatggcgtgatctctgctcaccgcaacctctgcctccccggttcaagcaattctgctgcctcagcctcccaagtagctgggattataggcatgtgccaccacgccctgctaattttttgtatttttagtagagacggggtttcaccatgttggccaggctgatctccaactcctgataaaggtacagtttaaaaggtacctcttttggagtaataaaaatgtatggactcaaatttgtcagaatgttaaatgggcaaaaggtggaggatactttctgaggaagaaacaggctagagagtgcacaagtaaatttaacgcttaaagtagaaaaagagttagaaagaatacaagggaaaaattacatctgatttccttttctgctaaccgaaatttagcctctacttccattatgcatccaggcagcagccacagttgcattagcaatacctgtgacggtctcaccagcagaaattatgactttcagtattttaataccacattcacagtggctccaaatatcttgaaatgtttactctcagcatgacttcgaaattataattgttattatatccaccacattaaatacagaatcacagaagttattatatcaaatatttgttgcttttaaagttttgcttaaaaacttcaatttctagtactacaatttcaatataatttattacctttgtcatctcatggctttctccttcttcttcctttagcatttataaactttattttgagaagtgtctacaaagtttgtcagactgcaaagaagtccatatctcataaaagatcaagctttaaaggtggaagaagaaaggaaaagtcagggttctgttaataaagttctgttttgcttctagcaaaaaaagcatatgctcccttatgaatacactaatggacaatttaaaaatcaatgtcagcgtaatgatggtaagcacagcttccaaacagcatcccttctagattgccagaagatgatcacgcagaccccgaagcttagggggcagccagaggcctgaacccctgtcctaggttaattcaccttttgcatggtaacaattgaacaccatttacaaagtagggagaattattttgattgatattaattgaaacttgcaaacaagcacaaaaattaagtgagcaacaaaaggattaggaagtgaaacctcgcttttactaatcatttccctttccctctacaaaacaaacaaaaaaagatatgaaggtaaagaaactatctactccaattactttaattcatttggatgaacattttactctatgaatttctagggatttgattctctgatctggccatactcacttgtaatcaaacaaaacataaaattgaccatttttgtatgctaattttgtgctagacaccctgttgaataaatgaaagaatattattaagcatatactacatgccagatactttcctatatcaaagattggcaaacttttttctgtacagggccagataataaatattttcgattttgcaggccacaaggcagtctctgttgcaactgagggcagtacaaaaacagttataggcaatatatacacaatgggtgattgcattccaatacaactttatttgcaaaaacagttatagacaatacatacacaatgggtgattgcattccaatacaactttatttgcaaaaacaggcactggagcatatttagcccacggcctgtagtttgccagcttctgacctagatattgcagcgtggaacaaaaggtcaaaaattccctattttgtggagcttacatgccaggaggggaagacgaaccaggagcaaagtgaacatactaattctatggggtattttaaggtgccctggtgaggaatccagcagggacaaggcgggagggtcgtgggggagctcacaacctttgctatggtgacaggtggggcacctttgagaagcaaatattttataaaatttttggcagaaatgagcaagcaagccatgggcaagagtattctagctgcttagatcattataatgaccatccaggataaaaaatattatttctctctgacaggagaaaatggagactcatttccttgtcaaaattctaatggctaagctcatccagaccatgaaatcggtaattctgggagcaggttaaaggccttgctgttttttctttctaaagctctctaggttattttaacatgcagctatggttgacagtcttcactaggtcatgctgacttttaacttattcaatttattttaaagaaaacaagctaacagaaaaatactttgataggcaaaaattaagttcatagggtcagatattcatttttgatttttattattttagatctagtcctgaattcagatttctttctttctttctctgtctttctttctttctctttctttctttctttcctttctttctttcttttctttctttctttctttctttctttctttttctttcttctttctctttctttcttttctttctgtcttttctttctttctttttgtatgtgtcagacattctatagcttctgagattctcattgtgtttgtgaagatattctgaaaagaagacagtaaaggacttattagggaaaattaaagtaggatctggggaaggctggagagaccacaatacaggagggtgagagaattaatatgaccctgaggcaaaatgtaagtgaatatttttgccccttccaagtaaatatgaattatttctaatcatctttgctaattagaatgggaaaaacacatttatcaaatcaatggttgcctgcaatagacatgaggccatatttgtctgctccagcaactataccatatctgtctgcaagcacagctattatttattcatctgtgctcatcaatagtctttttccaggatctgtccagtttttgcaggagccaaattgatgagttaaatggagacgtaacagggatcacccttgctgtattcttatgttggatctttaatggtggcacaagtctttgctgtctctcccaggatacaatattgttttttatttactattttggcagaggggtgagagggaatttcagaggtttccacttggcctttctccatgatgacagtttttttctcacattgcagaaacccaataagggggttcctacaattactaaggacgtccgttccaattatgtacttggagattgtagaaatgacctttgagtagattcatggacctagcagaccactgaaaggtggactttagccacaatttctaatttggcctaactctcatagccctctgtgctccaaagctgggctatgatggatctttggatttttattcgggtcaatcaatgtcaattcgggccctttattaagtagtctttgaaatggcttgttattcttttttcctcagtataaagaagcctaagtaaatggctacaggtccctttgaggaagattgagggcgttttcacagcatatgccatggtatggtagggtctttcttcctaggaataatgccagtggattctgaatttgaaaatttggctgaggtctggcaactgagcaggaacttggacttgttaacagtgtgactgtgcttgactttctgatactccgttctaactttttttcctagttatagatgttaagcaacattcttcttggctgcctattcatttacccactacagacactctattaaccatctcctcaagtccctgtgggccacacccccttggtcgcacctctaacctcctggcgtctagcggtgaagccccagaacctggcttctcctggcatggagctccatcatcttcatgatgttgttgagtggactcctttgactgcctctccaaccaccagaagagccaccaccaaacttattattgatgatggtgcccctctcccagcacattctttatggtcttagtgaagagtgagctttctgctccttctcttggactatgaccttctcttgggtcttttggtctgacataatatgcaatctctgcttccttcagcatatcctctggcttctgacagggcaatttgggcatttccattctgctgagtattgggcattgctgttttcaagtttctaagggctgctctaggaacatggttgcatcatttctaatcccaggagtgctcctctggttcctgctcatacaaaacagctaattcattcaactctttgggtgtatagagtccctcctccctgatcagggccagcatgttcccaactgggctatattagcatttccttcttggtattggcctggcaggaaaggagacatatctgtccagacatatgtccttgtaccacggtctctggtctcagtccttttctcacctgagcagtgacctcagccatgcattcatatgtccctggagctctgcagctctaaaaattaggtcttcctaattgtctgagctatgtcattcccttccactgtaggagatatgagcctccttgtaaactagcacagaggccctctggcttccagccttacccattaacgactcaacagccctcagtctcattatccttctgcagggtctttttttaatgctataatttttcctcaaagtcctgctttagctacctcataattttgatatgttacatactcatttttagtacaaaatatgttttgatttttctgagtattcccagttttctccataagtatttagaattactttaatttccaaatattcagggacaatcatatcattttccttagttatttgtagttaatttcattgcaattcaagaatatactccatatggtttgagtttattaaggtttttaatatattaggatataattattcttattgaatgaaccatgtttacttgagaagcctgtgtattttgctgttttggggtggaatgttctctacgtgtcagttaagccaactaattttgtttttgctttatgctcccacatcacatgtgtttatttttttttacaactttcattttaggtttgggggtacatgcacagttttgttcatgtataaattatgtgtcactagggtttggtgtacaaatgattttgtcacgcaggtagtgagcatagtagacaacaggtagtttttggaccttcatcctactcccaccctacctcctcaagtaggcttctgtgtctattggtcccatctttgtgtccacacgtactcagggtttcacacccacttataagtgacaatacacggtatttggttttctgttcctgtgttaacatctcacatcagttagaatggctattataagaaagtcaaaaaacaacagatattggcgaggttgcagagaaagggaatgcttatatactgttgatgggaatgtaagttagttcagctgctgtggaaagcagtttggagatttctcaaagaacttaaaacagaactaccattcagcccagcagtcccattactgggtgtatacccaaaggaatataaattgttctaccaggaagacacaggtacatatatgttcattgcagcactattcacaatagtaaagacatggactcaacctagatgtccatccatggaggactggataaaaaaaatgtggtacatacactccatggaatactacactgtcataaaaaaatgaaaccatgtcctttgcagccacatggatgcagcttctgtagggtcttaatacaacttagtgataaccaattgactctcatgtatctctacattgtttcgctgttgtgtatttctctagaggtgggaagaaaggaacacatgattgttgttacttggagaaaccacttaaatttctatttcaaagcatgtgtccatttttgagtgagttcctaaaaatattattttcccagtcaaatagaatttgtaacagcccaagatattcaagctttagagaacctgcaatatttcctaatcaatgagtaaacttcagatatacacactcatgtacacatatgcacccttggtaagaaaggacggagctgtgtcttggggtaaattatactataaggtgaaaatacttctctcttgctgttggcaaacgatcattccaaagacatgccactgcaaatggtttctcctgctagttactagcaagagtctgcatatgtagagccatctcttcactgttcatttttcaaggggcactgggctccctgggcaaactgctcccttgcagtgagcttgactctgtactctggaagggagtgggtaggtgatccaagactgacagtttatattcatctgactaggtaagtgtattgagtccaggtatacacagcagtccccacagagggcacctaaggtctagatttcaggaagacatatgggagactactagcgttcaagtcaaaaccctactgagtctaaagaaatgatgtagttcagatatgctgggcatctgcctagtctgttaacaggctgatccatttatcctgctccataagagaaaaactcaaaagcaaaaaaaaaaaaaaatcccctacaaaacttttggcagatttctgattgccctaggaagcatcttcaccccagcaaggagcattttcttccattaaacacgcaatctacagagaattaggacatgttcttatgctgtgacttttggagcattttaatttcttttttctagttcaaaattttcctggaaaataatgaagtgaactcagacaccacaggctctataattatgagatttttgtggaaaatcctggggacaatttggtttaatgcatatttatttaaatgtcataaaactcaactcatcaaagttgtagggccactttcaaacttgatgccatattcgaggaagacaggaaatgtagcagagtaagcctatgtcctctggaaattgattttgttacctgaatgtcaggggttcagtctaggtgctgttgcttgctgcaccgaaagccagtcattgatataacaagtactgccacggaagacagctttaattgggtgctgtaggagagcagatggcagatcagtcttaaatccacctgcctgagcaactgaaatgatgggtgtatgtagtgaggaagaaatgtaaccaagtgtgggaaagcaggaataagggaggggtaaagaagaagaactggtcaacaggaagcaggtttaggtaatcaccacaggtgatgagtctagtttctcatggtccagatgccatgatctggtaagtttcgctctttgatactgtctgggaggcctgatcctttattttctgagaaaggaactcagataatacaaatgtaacatgtttaagttttaagactgggaaggtcaatttttatgtttatttaaaagaaacaataaacatcagttctataggacaattgggaggcttttttatatctcaaagaactacaaacgttatgataagcaatttatacttgattctgccatgtatctacctttcttattataatataggatcagggttccaatgttgaaatggacaaaagccatcattccaaacaccccactggttctccaagccatgcccaagcacatcactctcatcaatatggggtatctctaaagaggggtaaatcatttctctctctccagcactcaacacccaacatgtatactcaagtttgcaggtgggtacacgaaaggacagttcttcttcacaaaacactagttacccttggcttcgctatgacacatttaagtggagaacattagggaacagtcaaaggtgtgttgaaattaattctcaagtattcaagctcagactgctaggtaccctactgactgagtctatacccaatgataccagcgaaaatgctgggaaaaaaaaaatgaaaaaaaactgtacttagcaaccctgcaacagcaagtcagggtacattatactgtaacttcttccatctggcagatgtatgcttcattacatctgcacagttagaggggatcgcatggcatattgtttcaattattatcaatagccaataccgatgggccgcttgccactaaaaaggatcaacatgtaatttagaaaaacggcataaactataagtacaaattgtactatttattactatcccgttattaatttgtacttctggatattatgattggtatttggtaatttccagctacttggaaataagaacatcctctgagagctaaacaataaaatcaatccacaaaaaaccaaagacgcgtgatgcaatgtcaccagggagagaaaagggatctcaggttacagcaagaatttactacaatcagattaaaggtattaatttagttaaagaagtgaggatgctagagctctgcatggatcacagaaaaaaatattaaaatcgggtaaaaacaaaaaccccaaacagcttcagtggacatcaggagacttgagggccatttgcacctgagactggaaagctatgcagacttaggcaactggaaattaaattctagaggataaagaggtgtaggataatttgctctgtccctgaaaaatggcagcctttatatatttcagaaccagccagaggacattacccatgcatgactttatcttcctgtgtagactccaagggtgctgttgggtccgctctgccgccatctttacacagcgtgggcagaggcacatccaccaccctctgctggtcttcaagtacacgtcattcagcagcgtgatatcctgtaagcagccagtatacgtaaaaacagcccagccatgggacagctctctcatccacaacctgcagaaaagagtcaagaagggcttaccgctgctgaatctgccgagttgtcatctgtttaaagtttgctcttatataaatatcacccacaattgagacagctgttgggcccagatatcacacaatatgtcatattaataaaaacaataaacacacaggcattattttaccttaatgccattgaaaagcaatttaattcgaggacacatcctattcccagcatgttatttttaatacaattagatggtcagagaagttttaatagcaaggtacttcaaatccaatattagttctgaagataccagatattgttttatgcaaagcttttaaatcacaataaaatagttatgacacagcaataacttagcagtcttttcccattaggggtaaatttcatcatattactctaaaatatttcatatagtgtaaatctactctttatttactttccgtaatgtctatggtatgcttagtatcatgtattcttcctgaaataaacagccctttctctgacctgccctaatgcttgccattttcagcctctgcatcctccaagcagccccttcattagaccactttagtctttagagtacggacaggccagtaagctcctgtagcccttattagttacaatatgatattccttataaatttgtttgcaatgtatgctgcattaaattgcacattttggagcgagggcaatgaatactttatatgtccatgttctccaaagaacttaagaaaatgctgaagaaagtaagaacttcagaaatacatgttgattaagtcactgataggaattttggagaattcgtgtgtgtattttctttcatcgcaaacacacacacacacacatgcacacgcacacacacacagacacatacacaaacacacacggagggattaaaattttcaaccaaattgaaatgtcgaagttaaagcgcttaaaaagaggtggtgtcaattctcattactcatggtagctgtgttctatgaagttgctgggaacagagcaaacactggactatggtttctatggaaaacacagggttaggtttcttagagcctatggtcataaaaattataaccttgctttatatttatttctattttaaaaaattaatatatattgttgattcaagcgataattgcttctcacttatatggagaaaagtcagaaaaaggataataagcaaaaacctaatggcttttatatcttagtaatattgagtatacacagtaattttctgtgtatggaagaaattattcctctaagctagtgctaataaaatgattcatttggaattaatacaatcctaaatctaatttagcctatacttaagaaaatgtacattctattatcaatacattccctatacctattttccttattattttaaaacttgtctgacacaaaccatcatcaatctttaggtttttaggcttttaatatctaatatagtattgaattccttgtgatgtagagaaaatctatagtaaccatgttttaaaagggttgaatactgttataattctataaaatgggtaaaaagcatttttattaaattaaaaaatcttactctctttcaaatttgatttatcacaaaattagcctgtcttcattttttcctaaaataggaaaaaaaagcagttaattttagttttaaagacatcataagtttaagaataacttatgaaaaataacaaccaataaagtaatcagaatttagtgttgaacatgagtaagatattgagaattaaatctggcaggagagttagggacaataaacgaccattgaactagaaatgagaagatttccactgttgctccagatctgatgctgatctggtcatggtggacaggtcacacgtgtcactgttcattcagtaaatattatcaagtgactactatatgccaggtgctatagggagaattggggtacaccagcaaaaaatagagaggcccctcattcttgtttgctgatgttatagatattccatccagatttacattttcatggttccatgagtaaacttgacacctgctccctaggtgaccgcatccaatctcatccttttaagcactctccacatagtaactacatccaattttttatcccaagtctgtagctctcttccaaaatctaggtttacatatccagctgcttggatgcttaatcggcatctcaaccctagccagacttctgatcttccaccccacctgctctcccgcagtcttcttcacctcaattagtggccactgaagccaaacttccgggagccatcctaaagatccctcttttccaccaccaagatttcctttggctctgtattgaaactaccatcccccagaacccactggcttctcccctccacacgcaatggccttgcctggattcctgaaatagcctcctaatccgtcgtactgcacctgcccttaaccctcacactgaaatctcaacactgtagctaaggtgatattttaaaaattcaagtcggctgggcgaggtggctcaagcctgtaatcccagcactttgggaggccgaggcgggctgatcacgaggtcaggagatcaagaccatcctggctaacacggtgaaaccccgtctctagcaaaaatacaaaaaattagccgggcgtggtggcgggcgcctgtggtcccagctactcgggaggctgaggcaggagaatggcgtgaacccgggaggcagagcttgcagtgagccgagatcgcgccactgcactccagcctgggcgacagagcgagactccgtctcaaaaaaaaaaaaaaaaaaaaaaaaaaaaaaatcaagtcagattctgtcacttcttgctcatttattctaataactaaatacctacatttagaaaaacatccaatcactttacagtggcctcaatgtaaccaacagccccacataatctaccccatttcctctgcgaagctccagccacccctcatccgctccagggcagccctgcagctccctggccccattgcacatgcgacatgcagagcactgcgagttcagtgtcaatggatccaccatgtaccctaacccatcacagtccccggaagtgaggccttatcacgtggagtaaagtggaggatcgcccttcctttaggtgtctttccacttcccatcttttaaatatacatgtctcaggtatttcttctacatgcattgagcatcccatcagatggcatagtaacttttgcttcaaacatcaaatatcgcttttaaaaactcatgaggtatggccaggcacagtggctcacacctgtaatcccagcacagtgggaggccgaggcgggcgaatcacctgaggtcaggagttcgagaggagcctggccaacatggcgaaaccccatctctactaaaaacacagaaaattagctgggtgtggtgtctggcgcctgtaatcccagctacttaggaggctgagacaggagaatggcttgaacccaggagccacaggttgcagcgagcccagatcatgccactgcactccagcctgggaaacagaatgagactccatctcaaaaataataataataaaataaataaaaaacaaaaataaaaaaatgcttctgtcagcccttctgtaagggtaggtttattatgcaactaatttctcttgttttcttttgtctagaaaacctctttatttccctttcattctggaaggataatttctgtgggtatagaattggcaggtgactattattttctttcagcacttggaaaagcacttcattcatttctggtctccatggtttgagatgagaaatctgctaccatttgaattggtgttctcctgtaagcaacatttcatttctccctggctgctttaaacatttttctgttttatcttggactccaagtatacaaatgtgagctcttttgttattgacccatgagactctgctgccctataattgttttctctgtttttcagatggaacaaattccactgagctatcctcaaggtcacggattccatcctctgtcacctccacttcattgagatgacatattgagcccatgcatagccttttatttgaggtattctcgtgattttcatttttaattctaggctctacttttgctgaaattttctatttttttcatttgtttcaagagaacccataattgcttattgaagcatttttatgacaattattctaaaattctttgcaggtaatcccagcacctgagtcatctttatgttggagtctcaattgactcttcattcatttgtgatttttctggttcttgctatgataaatggttttttattgtattctggacattttgataagattgtgaatcctatttactttttttttttttttttgagacggagtctagctctatctccaggctggagtgcagtggtgcgatctcagctcactgcaacctccgcctcctgggttcaatcgattctcctgccacagcctcctgagtagctgggattgcaagcgtgcaccatcacgcccggctcatttttgtatttttagtagagatggggtttcaccatgttggccaggatgttctcgatctcctgatctcgtgatctgcccacctcggcctcccaaagtgttgggagtacaggcgtgagccaccgcacccggcctactcttttttttttttttttttttaatagccagcttctctgttgagatgtagcaccagggctgtgtatctgttcagtctcctttgggcccagggccagtacgggagggaagggagagcagaacgcggaccactctaccttgcattgcctcattgtgtatcatcgatgcctggtggaagtgggcttactctgcatcctgctgacaccgcagagaaactggagcccatggcctgcttccctgggacaggagctagggtggaaaatcagcttccagcttggccctgctgaaaccctggcaggggcaggttccactgtggtttggctggaatcgagcaggtattgccaacagcatcgtctattgttggagtacctttgccccagaccctgagatggggtaatttttaaagaaaagaggttcaattggctcacaagcctgaaggctgtacaagcatggtgcccagcttctggggaggcctcagggagctttgactcacagaggaaggtgaagtgggagcaggcacttcacatggcaaaagcaagaacaaaagagtgggaggcagttgccacacacttctacatgaccagatctcttgtgaactcagagctcactcatcacccaagagatggcccacgccatccatgaggaatgcactcccatgatataaacacccccaccaggccccgcctccaagagtggagattacagttcaacacgagatttggtgggggcatatcaaaactacattaaccttaaattatgaagacggtaaactaaataatctgctttctttcctttcctgttttgtgtctgtttttcagatttccaaggccagcaatgttctcttcctctcccttttctttgtataaaaattcattctcaagaaaaactctcatatcaattgtttacatgtcactatggctaagacactaaaagccctctccctgcaaaactggtggcaaagctctctagagaaccacaaactgttgcatccttactacgtggggcagcagcaagcccaggtgaagatgtgcatgttcttggagaaagtattaataacataccgacacttacacctgggtgaataatttcatcaaatctcttaactcacacttgcacagacttcacctggagagagagagggaaagctgtgccagaaaataatgggtattgaggtcaccatttgtttgtttttctcaggagtggaaggagattaaccagggtggcaataaacaaaattacttgctgttttaaaacttaatgacaaccctataggttattaacaatgccaaagttgcagggcgcagtggctcacgcctgtaatcccagcactttgggaggctgaggcgggcggatcatctgaggtcgggagttcgagaccagcctgaccaacatggagaaacccatctttactaaaaatacgaaaaaaattagccgggtgtggtggtgcatacctgtaaccccagctactcaggaagctgaggcgggagaattgcttgaacagaggaggcggaggttgcgatgagccgagatcacgccattgtactccagcctgggcagcaagagtaaaactcagtctcaaaaaatacaaaacaaaacaaaaagccaaagtggaaaagcaaaaattttgtggtatttgcattcaattattatgctttaattcaaccattcacaatttctagggaacattaattttattgcaatcccaggtaaatttaggataatttaacaataatcgttggtgttctactcatctacttgtctttaaaatccacatatattttttaaaagatgacatcctttaaaaatattatattcagtgaattttcaatattattttaaatattgtcatggacagttgttattggaaatgacagttcaccattgcaaatcaatgcagtggctacaagtcccccgtgtcacacaaaaatagacggggtagctctgacagcatgcatccttatgccctgttctattaataatgcactgcgccccatcagggtctgcagctatatcattactcacagagacggttctgcctttggctttccctggtcctccatggctaggaacatcatttaacagggttttacagaattcactgggtggttagtcttagaaaacccaaggcacaaacacacagccaactacccccaagtgcttgtgcttgaactttcagaacataagaaaattgtgttgaagctggatctgcaagtacaaatggagagtgaaatgggttctatagaatccaaatgacacactctttcctcctgctaagaattactggctattgaaccaattcctgcctattaactgtgaggtgaagtccaagatccacagtcaagcattcaaagatccaacctgatttttctctgcataactgttttactaggagtaagactgacttgcctggtttaccaagacagtctgtgagaattcttcccgcttacctttactgagtcaatgtggacagtttgaaataacttaaaacattcttcttacatttttaaatcctacacaagcctcaaaacaaaatccaagtcacttttcctctgcagggtcttcactgagccccccagcaggcattcctcttgctatctcctgtgtgaatagctctgaaggtctgcattgcaaatatgacagtcaacacaccggctaaggtagaacaaaaagtggcattattaagctgaaaaaagcccggaccaaaatgaaagattcttattgtgggagcaattgctcacactcaccaatagctgcttgtttccttcttgggcacacagaaattacaattcccaactttcctgcagttggatagagccatgtgagtaattccagcctggggactctgactagagatgaaaatcccctccacggtggagcaaaatcccctgagtggccctccagccttctgttctccagctgtgctaacctggaagccacacattgagatgacagagcagcaaagtggagacaggccatgtctctgagtcaccatgtgacccacaggagattttgagtaaattaaaatacaaatctttgtcataataaaccacagatatttcagcaatgatttgcaaccatagcgtaagataacctatcatggctaatgctcctaggttctcaacctgtatccaccagtaactagatagcttgggcaaattatcttctatgcaacctctggttgataatgaattccttttataagtaagagaatgagctggaacccaaatgcgtacagaggaaatctgaatgaagtgggaagggtaagacgcagagtgagtggagacttcactcattgttgaaagagggcaattgctactcagttattactgatgcttacatgaagaaatccagttttaatataaccacatcttgccatttctcaagggaagtcatgtactatctgtgtatctgtccttcatatagctccatcaatattctcctcttaaatcttggagactgtgcaggatgttttccaaatgtctctcctgatccagcctgcagtcttctctaccctggtttgggtatctggagccagacctgtatgtactgcatcagcaggttctcttcccttcgctttctgcatgggttccaccaccataaggtcctggtgggagatcagaggctgggaagagcagaggctgggaagagcagaggcaggagaggcactgcataactcctctcaggcagccctctctctctggctctctgtaggtttgggcaactgctccttccatccatatattcaggctgagttgtggaaaaggctcccaaatggcattagctccagagtgatgcaccttccatatccttttattttcattatttctcctcctttgaagaagttgagtatttttgcaagaacattgactaacaggaactaatcaattattcttaaattaaaaaaattgaatgaatcaaatgttcaacaaaggatacacacacagactgaatgacaactaagttattttacagttccacaaacctagggagatctatcaatgaatggggtattacattctaatatttctaagactatattgaatattgaatattcaatattctaagactatattgaatattcaatattctaagactatattgaatattcaatattctaagactatattgaatactgaatgactacatcacctacaagaatacaatgagagtactaaactaacactcagtactaaacatttgtcctacactcagaggtagacaccaggttctggtgtcaatgtatgatatgcctgtctctaaataaacattttatcagataacagtctttgaaagtcccagtgcaatagtaagtatagtctggcctgtgtatccatgggttctgaattcgtggattcaaacaaccacagatcaaacaatattttaaaaaacaagtatggttgtatctgtactgaatgtgtacagactttttttgtatttccctaaacaatccagtgtaacaactatttccatagcatttacattgtattatatattataggtaatctatgatgatttaaagtatatgggaggattgtgtaggttatgcatgaatactacaccactttatagaaggaacttgagcatttgtggatttcggtatctgcaggagggtcctggaactaattccccatggataccaagggacaatggtatatacacaaagttttacacctgattataaaagtatgtgtatgatatttaaaagtaacttcaatctttgctccataacaaatgagaattaaccataagttccacccaaaataatatttagaaaactatacactagattactcttagtttttgtggctgtgtactaccgttatcctaaaatttgataaaatcattttaaatgccttttaaaatatttttttaccttggagattaccaccaagaaatgaaaaagaattctgaaccaaatcagaagtttgagatttgaaatctggctttgctactaacaaaccctgtaaacttagaaagtatagtgcaatcaattcacaacaggctttagaataggccatatgagtttgaattctgataccacgtttactaatcacgaaacttgatcataaagctattgtgagaagtaaccaagataacacacacaaagggcttagcatggtacagagcacacagtatatgaaataactctcatacagtaagtgttaactattattaagaattttaaaaataatttgtaatgcaagtgtcactgtcaagttgcacaggacccagaaagaggataagaacatatttacagcttttcttttattattttttaaaaaatcaaataaattcttgctgaaaaaactaaaggcagagggaggcaataagcagtatttggaatgaaaacaaaacaaaaaggtatttcctcttcacgcatttctcaaattccaaatcccctccctaccaccaccactgctgatactccttccctccacaaaaggaaatcactctttaggcttaggaaaagactggcaaaaagtatcttggaattttcacaaatgtgcatccacaacacacatacatactccttttctaaatacatcagatcgtactacacatctttttctgtgtcttggacttaaccattcaaattattataggtatcattcgatgccagtaactggagttctacctcatttctaattcattttattgtagtgtaatttacatacaatagaatgcgcatattttagttataggttttgatgcaattttatacatgtataggcttgagtagcctaccttgatcaagatgtagattttcccaactccgaaaagctccctgtgcccctttgcagacagtctggcctgccccatgctcagcagtgactgacctgctttttctactgcagattgtacagttcgtgcaaatggaacaatacagtggtgtcctctgttgtcctctgtttttcagtcaatgagtagtacttccatttatgaatatattcttcccccacccccacatttttttttttttttgagacaaagtctcactctgtcgcccaggctggagtgcagtggtgcgatcttgtctcactgcagcctccacctcccagggtcaagcgattctcctgcctcagcctcctgagtagctgggattacaggtgcttgccaccacgccaggctaatttttgtatttttaatagagactgggtttcaccatgttggtcaggctggttttgaactcctgaccttgtgatccacccgcttcggcctaccaaagtcctgggattacaggtgtgagccaccgcgcctggccacgaagtggtatcttaatacagttttaattctcattgttctgatggctaataattttgatcattgtcttatgtgctcattggccattcatatattttcatttgtaaagtgtctgctgagtcctttgaccattttctatagatagcttgtcttttgattatttagttataagacttctttataaatcttgggcagacatatgtattgggaatatctggttgcaatctgtacctagcctttccattttttcaatactgtcttcttgaagagcagactattttaagtttgatgaagttcaattttgcattttttcttttatagttaataccactgtcttctgttttaaattttttgccggtctcatgtttgcaaagttattcttctagaaattttatggttttgtttaagtccatgatctatttctaatgaaattttgtatatgatctattttatgaatgaaggcttagtgttttcttcacgtggatatcaagttgtcccagcaaatttgttatatgctttcctttcctcatggactagctctcgtgtctctgttgaaaatcaattgatgatgacaaatctcttgaaaatgagttgatgatatatgtgtgagtcaaatttaccccatcaatctctttttctcttcctacaccaataccacagggcctttattcctatggctttatagtaaatcttggaatcagatagtataagtccttaaactttatactttttcaaaatcattttgtatcttatatgttctttgcatttccagataaattttatgttcaggtatcaatttatatgacaatttatatggcaaataatgaatatcatacagtattgagttttctgattcataaactatatctctccatttaattagctttctttaatttctctcagtaatattttgctatttttcatgtagcagatttgcacaacttttactaaatttattaccaatagttttatgctattttgatgcttttgtatgtggtagttttaaattttttattttcaacttttcattgctagcgtatagacaaaaattgatttttgtgtattgatgatgctcagttcatcatcagttattagatctggtcctttatttgtaaaccccgtagtgttttcttcatgtcatatcttctgcaaataacaacagtgttacttcctttatatctttttgtcttttaattattttgcttgctttagtgtcctggctaggacatctagcatcatgttaagtagaaatagtgatagccaataaggcttttttgttgttgtttctctgttaatttttttatgcccatatcacatttccactcttttcccccctctatagataattttttcttttctttttttttaaaaagttctgggatacatgtgcagaatgtgcaggtttgttaacataggtatacatgtgccatggtggtttgctgcacccatcaacctgtcatctaggttttaagccctacaagcattaggtatttgtcccaatgctctcccggtaaagaatatttaggttgtttccaacttccaacttctcatcagcattacaattgcttgtaatgagcattcttgtagacttcaaatgaggatatttccaattagaaagacgaggtttccatttggtatcattaaaaatctcgggaacaagatagcagtgatgtttacccaacattgtgagtgcacttaacactactgaattctacactttaaaatggtatattgtatgtcatgtatgtttaacatgacaagaaagataactgatatgttaaatgtgtgaaaataattttttctcttaagtagttcagttttgtttacattattgatttgcttagtcaaactcatcctcatagagaatacaaaagtaatcttgcccaggccaggcatggtggctcatgcctataatcccagcactttgggaggctgaggtgggtggatcacctgagcttaggagtttaagaccagcctggccaacatggcaaaaacccatctctaataaaaattcaaaaaaaagtaaccaggtgtggtggtgcctgcctgtggtctcagctactcaggaggctgaggtgggaggatcacttgagcctgggaaatggaggttgcattgagctgggatcacaccactgcactccaatctgggtgacagagtgagaccctgtttcaaaaaacagaaagtaaaccagcccagatttttgctaaattcataaggttctactaatgaagctgtagaatgtaactgaagaatcattaaggagactgagtctagccagttccacccatgtcaataaaaagagcctcagtgacttttttcaaactgtaataactcatttatttttctttatatatttatatatcaaactataataaattatatatatatatatatatagagagagagagagagagagagagcaacttttatgtttctgcattgaaatattttagtgcttcaatgtgtggagtggaaaattgccttcagagaaacaggctctaaatttgaagagtcacatttgacctatattttgtataggtgtgatggtgtgtatattgaccatcaatatcatactttgacacaaattcctgaggaattagtgcattcgagtcagtagagctgtctgtgctaaagtgtgcaggtctcactgaggaactgagaacgcatctgagtttcaaagaaagaggtgtttgaatacatttgagttttcaaagaaaagagtgtttgccagaatggatgaaggaggttgctccaaatgtgggaagcagccagcgtgcctgaagcagaatcagggaaagaaaagtgtgtggggcagtcagaaggaatatatggttagtatatataagggacatacagcgatggtggatgaaaacaaaccagtaaggaaaaaacaagtggaatattgatgtcaatttgctgaattcaatcagcataattttaacatttaattaatatagtaagacctagacaatgaatggactttgtcatatgaatgttatagagttttagaaataacgtttggtacatcgaattaacttacacaatcaattcaaaaagcacatgtatatcttcaggagtgccatataatcagacaaatacaacttaattaagatttgtgattttattagtcaaagaaaaaaacattagggaaggattcacctaatcctaattgcatgttttatttagagtaggtaaatggaacagatctttattttccaaaatttcctagtatgaaatccactctgcaaatgtcataacaatccatatgactttaccagagagtagctgaaatagtggtacatactggctgataaaattagatactggattaaaatagatatttttattaataaaatcctaattcccttaacaatgttattcatagtagcctctaagtacattttgaaaatagttgtgtataggtgaattaactactttacatatccagaatctagactcttgtaacctattgcaaggaatctacaaattcatagctcttgtactcctgggatttacaacctactggtgtaaaaatcctgctgtaagagaggtgcatattcaaacaattttgtattaattgtttggaatgattgctttgataggtaggtcatcaatctacaatacttatgctcacaataattatccgaagttatctcctactgctgcctggatctcaactgagagataaactaatttctcttcattctttatatgaaacatgagtatgctgagctatatctcatctgaggccccttctagttctaattattatataattttatgcaatgaaaagttaaactaaagttatggttgttagcgtatgtctcataatatgccttggttcagggttcttcctagaaataacctctaaatcaaggattatcacattcaagaagttcagtgggaaggtgaggccaagaacactatgcggggagtgggaattaaaatgtattagtccttgttcttcaagaaacagacaccatgttgggaataaacatgaaaggacttgattagggaaaatacctgtgtggggaaaaaaaacagagtgcctgggatgttagcagattaaaactttaagtctgctcccagtggaaggaaatatgcttgggtgacttctagggtatgaaaaagttcttcaggaagtccttgaaccagagctggctaccagcaaggtcccacacctgccagggcgaggcctgcgctagtatccctgccatactcccgttattggctaggagtaggaaggtgtgattgcacgcaaacgctgccatggattccaaagcacagcagcagaggccttcattgttcctctctaggtacttggagttcttccagggcgttaccgtgactaccctatgagatatggaaggtaagggaagccaatacaggatgtgctgttaatcaagtgaccagtgtgggccctgggaaatcagaaagacagggtggaacatgtgcctcaaagttatcctatcttagggttgagggctggggtatttatctgccaagtcccactggtgagttctctagggctgtgggtggggacaaacattccatgaaacccccaggctgccatacacccagacaggctgcagcaaaagccctcaggcagctaacgtaggtgcttgcaattgaaagtcaggctggtgggcacagatacagccagtgccaagaggatatgggcaggaccccaacagagtctgctgcaatgcatgggaaagatggtggcaatgtcaatggaggtccatatggtccctctccgcagttcttcctccagcatcaatgccatttggaataatcttccaaagacagagcacagtcaggattagttatgtgtagatgttttaacagtaaaaatactatgggcttcacctacccctggctgttgactttttcaaagtagtgcagaaatcttaggacagcctcctgccaaagagttacatttattcctatcactgcccactgcaaggctttaatagcccttttctctttctttatgagatgcattgaaaagactatctaaaagctaaataattaggaaagaatatcaacaggaaagacctaatagactggaaggtaggaaacaaagcacaggacgattaaatttttaaaacacagcagagctagcattccaataagccctaggaagcctagcgagctttcacggagtacactccaggggcagatagtgggtatgatggtataggtctccacagaagaagatatgtagaacagtcttctgattggtgggaattgtttgccaaaggcaatcttgaactatttcacagctagcctggggttatgtaatcaatggtctttcatagcggcagaaagtgccaaagcaaccaaaattccaagttcaactggatttacttgcatttacttactttacatgatgtgcctacaaatatacaactatcaatcataggtcccaggaatgtagcacttttgcagtatgtatctagagttactggcaattggttcatgacattattgggttcaggacattccagaattgccctagatgccaaggtgtcaattatgtacttggtatgagtgttgggcagaaacatcacctctattgaaagctcaaaatgcattcagaaaatattgatgaatgctaatactaacttaattgtggaagtgttaggtgttcatcataggaaaaccttcattatcatggatacttttctctcagtcctgcctctagattgatgagaaagaatgatctacaataaattcaattcatgcttctcccggatacagggttaaatgtgagacagcagcattttagttgcattaaaaatgtccccagttattgcttcggcctccctctgctgtaaaggctggatatgagtttgcatagcaagtagctaaacttaaactttcccactcttctgaaagatggatagaaagtttaaccagtaaaaatataatgcacaaaaggtaagttcatttttagtgccttgcagcctgcttagttggtgtaaagaatggactactgaaagatagtaaaagcagcgaacttaaaattttactatgagaaacatgaaattgtcaccgaaatttaatttaaaaactcacagaattgttggcataacagtgacttacagcttattcatcagagcaagttagcagaaacccaaatgctattctcagatatccattcttttctcagatattgacttgcgtgtttttacattcctaatgaaattttttaaaagcaacatgtgtagttgtcaagcaagctaaattggtagccaaatgaacccaacgacgtgaggctgcattacattttgtaaatcctaagtcatattcaacttgttctatatactgatttccttattcctgttaggaaaggaagttgaaagtttagacttgtccagatttcagctttgaggattcctctgtcacatgaggcttggggtggtctgcgtttgtttcagcttaagagccatagcaaagatgcttgggggtgttgaaagcaacagctacattgcggagaagcgaggacagaactcacaggtgtccagaaggagagtgagctgtgggagagagcctgggaatgggcagcgatggaggaaaggagaaatgttgaggacccctcacctcccttgtactttgtttcttgaagcctaacgttttgtaatctattgtgttgtcttgatcatccaggatgaaaaatggatctctaatgaatacaatcatatctgtaagctacagattttactatcaacaatatgatctattagtaaagctggccacatgacactgaatttactggccttcgtattaatcatataaaatagtgaagggagttatagtaggctgattctgagatggctctctgtgatctcattggaagagagatgtttattatgatatggcaaaagcctagtgctaatgtggtctgcagttatgctgaaaacagaagatatacctgatagacttggctacatggctaaggagatttccaggcagtggggaagatactatttttctcttgctgcttatagcatgatagaagagccataaagtgagggaagaataaaacaggagagcataaggtcaaaaaaagatacattaaggacatctggctttaactccaatgtgtaaagttcttaaaagtcattgcttccactcttaccacaagaagaacctgagtgaactgaaaatcagtgacaattcatgtatccaaatgagaatgaagttcctacagcaaacagccacccagaaatctgcaaagatagatgaattaggggagtcacagctgagatctgtttacctggtgcagaaaccactagaaacaaactcttggtagcacttcagtggcaatgcttatgattttccggagcactagtgtggagtcgcgtgagagtgataaactcctggggtcacactcttggaatcccacacagttgtggattttacctccagaagccccaccaagctctcacagtaaagagttgagaaaatgccatcatggtcatgtggggcgcatggaagagaagttattgtgaaatatacccagaatattctccatgacaaagacctaccctccagcgagggataaaacctttagcagagacttatcccacttgagggaaggtcacttttcttactctggacaccaatatccttcctgttccttgtaaggggagaagcaaagctaagaaatgcttgtaagggacatagaccccctaaaagactgtgatgtaatcataagagtatagaatacttcccctatgccaaccttctcaccacactaacagggctccaatgtaactgtggattacacctaaaagagccagaaaacacagactctctgtggaggcgtatataaggatgcccaaagtcaagagtggagacaagataaggatactagaggaatttgaagccaccgctacctacatctacagcaaacattatatatagcttgattcccagccagattaataataacaacaaaaaatgctcactaaaggcctgtttgcctcactgattactattcaatacattatgtatgggttttaatggaaaattttaaggtatcccaaaaggcaagaaaaagcaagtcagaaagacaaagcaagcatcagaaccagactcagatttgacacaaatttggaaattatcagatagagaatttaaaataactatgttttagattttaaagactctaatggaggaaatagtcaacatgcaaaaatagatgtgtaatgtaagaagagtgatggcaactctaggaaacaatcaaaaggaaatgctagaaataataaaaatcactgacataaataaagaatgtcttcaatagtttcatcaacagaacaagtttgaggaaagaatgagtaagcttgaagataagtcaacagaaataatttcgaaagtataatatacatctatttggaataccagaaggagaagaacaagaacaagaaactaaagaaatatttgaagtaacactgtcagaggattttcccaaattaaccacagcaaatcacaagtcaagaagtagagaacagtaaacaggagaaataccaaaacaattatacacaaacttcagaaaaccaaagacaaaaagaaaatcttcaaaggagtcagagaaaaagtaacctgacttacagcaaaacaggacaagaattaaattagacttcccatcagaaacacagaagcaagaagactggagtgaagtatttaaatgctaaaataaagaaaaaaatacaaacttgagaaataaagacttcctcagacaaatgctgagggaaataatcaccatcagaccttccctgtaagaaaatattaaaagaagttcctcacggaaaaggaaggtgataaaggtcagaaactcaaatctgcgtaacaaaggaagagtgccaaagaaggaataaataaaggtaaaagaaaatcttttttttcttttcttattcttaattgatctaaaaataactatttaaagtaataatacgatgatggtatcatatgatgagtgaagtgaatgacagcaatgatggtggcatagtgtcatttaaaggtggagttagattacttaaaatgtatgttggaaactcaggctaccattaaaatatttttatttttatattttttttgagttgtagtctcactctgtcacccaggctggagtgcagtgatgtgatcatggctcactgcaagctcctcctcctgggttcaagtgattctcctgcctcagcctcccatgtagctgggattacaggcacctgccatcatgcctggctaatttttgtatttttatagagatggggtttcaccatgttggctaggctggccttgaactcctgacctcaggtgatccgcctgcctcagcctcccaaagtgctgggattataggcatgagtcactgtgcctggccttaaaatatttttaaaatatgtataattaatatgctaaaaaagaagataaaattgtgcaaaatgtcctattaaaatcagaaaaggcagaaaagtaggaaaagtaaaaaataaagaacaattatagcaaatagaaaacagtttaaatatggtggatattaacctaataatatcaatagtcattttaaatctaaatggtgtaaagaagccaatttgaagacaaaggtgttcatagtggtaaaaaaatccaactatatttaatctacaggaaactcattagaaatatacagacataggtcaaaagtaaaggttttaagaaatataaatcttgttaacactaatttttaaaattgcatagaactttattagctgtgaacaaagaagatagcagagcaagaaaaattacaagggaaaagaggtgcattacataacgataaagggatcaattctcaaaaaagacaacaatcttaaacatttattcacctaacaacagagcaaaaacacctaaaaatgatgcaaaagctgatggaactaaagggagaaatatacaaattcaccattgcagttggagacttcaaacttctttttcagtaattcatagctcagcaggtagaaaatcagtgaatacagttgacttgaggaacactatcaatcaatatgatataattgacatttatataataaaatactacctacaaacagcataacatatgttcttcccaagcttctatagaacatacagcaagataggtcacattctgggccataaaacacataggaacaaatgtagaacaataaaaattataggaaatatattatcaggtcacagtggaattaaactagaaatcgggaacagaaaagtagctagacaatcccaaatatttggagattgtcttaactggtttagtgtagctataaaagaatacatgaagctggataatttatgaagaaaagaggtttatttggctcacagttctataggctatacgagatgcatcgtgccaccattttcctggagcccttcaggaagcttccactcatggcagaaggtgaagggcagccagcatgttcagtgatcacatggtgagagagaaggcaagagagagaagagggaggggtcaggctctatttaacatccagcttttgtgggaacaaatggagtgagaacgtgctcatccactcaccaagggagggcattactctattcaggagagatccacctccaagacccaaatgcctcccatgaagccccatctccaacactgggatcaaatttgaatgtgagattttgaggcaacaatcatttaacctatagcagagattaaataacacaattctaaatatcgcatgatctaaataagtaggctcaagagaaatataaatattttgaattaaagaaaaatgaaaatgcaatttatcaaaatttgtaggatgcaatgaaagcagtgcttagacagaaattaatagtattactgaatatataagagaagaagaaagatccaaagttgattatttgaagttatagaagaaaagcataaaaaaattagagcagaaattgataacatctaaaacaggaaaacaattgagaaaatcaaagaaatgaaatgctgttctttaaaaaatcaataaaattaattgataaatctctagttaaggtaaccaagaaaaaaataaatgtactacaaattgacaatatcagaaatgaaaacagggtcatagctactgatgctatggacataaaaagaaatatgcaaaaatactagaaacaactctgcatgcccacaaatttgatggctgagatcactggtccccagcatttttgacactagggactggttttgtggaagataatttttccctgcacaggaaggtggtgcggtgggaaggttttgggatgaaactgttccacctcagatcatcatgcattggttaggttcttataaggagcatgcaacctagatcccttgcatgcaggcagttcacaatagggcttgcgctcctatgagaatttgatgggagggggagctcaggcggtaatgctcactcacccactactcacctcctgctgtgtggcccttttactaacaggccatggattggtacctgtccattgctcaagggttgaggacctctggcttagatgaaatgcaccaattccatgaaatagaccaacttgtacaagaagaaatggattatcttgacaggtgtatttgtattaaagacactgaacataactaataaccttccaaaaagaaaacagcaggcccaaatggtttcattagaaattttgtttttgtttcttttttttttcttttttttgagatggagtcttgtcctgtgacccagactggagtgcaatggtacaatcacagctcactgcaagctccgcctcccaggttcaagtgattctcctgcctcagcctcccgagtagctgagattataggcacccatcatcactcctggcttatttttgtatttttagtagagaccgggttttgccatgttggtcaggctggtctcgaactcctgacctcaagtgatccacccgcctcagcctcccaaagtgctgggattataggcgtcagccaccatgcccggcctcattagaaaattctgccaagtattttaaaaagactcaaccaaatcctctataatatcttccagataataaaaacagaaagagcagcaagtggaatttattctaggaatgtatgactggtttaacatttaaaaattaattactctaaggctgggcatagtggctcacgcctgttatcccagcactttgggaggctgaggcaggtagattacctgaggttggagtttgagaccagcctggccaacatggtgaaaccctgtctctactaaaaatacaaaaaaaaaaaaaaaattagctgtgtgtggtggtgcgcgcctgtagtaccagctactcaggaggctgagtcaggagaattgtttgaacgtgggaggcggaggttgcagtgagctgagatctcaccactgcactccagcctgggtgacagagtgaaactcaatctcaaaaataaaaaaagattcactctaatacgctacatcaacaagttagagaaaacaaaatatatcatcataccaatagatgtggagaaagcatttgataaaaaccagcacccattaatgataaaaactttcagaaaattaggaatagagggggacttccacaaattggtaaagaacatctacaaaaacctacagctaacatgacagctaatggccagacactggatgctttccctttaagacaaagagcaagacaagttgcttcttctcaccactcctattcaacatcatacaggaatttctagcttgtgcaataaaacaggaaaatgaacaaatatataacagattggaaggaagaataaaaactgtctttttttaagcagataacatgactgtctatcaagaaagttccaaagattctactttgaaaaagtcaacaaaatgggcattctgaaaataatttgtagtataacaaatttacaggatacacaatcatgtgtatatagtattatatgaatacataatttgtattgttactatatgtataatttgcaccattactatacatatagtagtatagcaaagttacaggatacacactgtctctctctctatatatatacaaatatttgtatttgtattgttactatatatagtattatacataaattttgtattattatatgtttgcataatttgtatgttactatgtatttttaaatttttttattgttgctgtagtaaactaccataggactagtgttttaaaacagaatgaattcattgttacagttacagaagtcagaagcccaaatacagtctgcctgaaccaaagccagggtcagcaaggttcctttccactgcttttgccaacttctagaggccacctgtattccttggttcatggcccctctcttcatcatcaaatgatcagcatagctttatgacatcagcagctctgattttgctctcttgccttcctcttatgtagacccttgtaattacattgggtacacccagataaccccaaataatctccctatctcaagattcttaatgtaattatatcgggaaagtcccttttgtcataaaagataacatagcaacggattccaaggattagtatgtgagtttcttttgaggggctataattaaccctaccacaatatagaaatgtctattgtttttctatataccagaaataagacattaggatgtgaaattaataacataacaccacttgcggtatcaccaaaaataaaataactaggcatacatatggaaaaatgtgaacaggaactatgtgcagaaaactataaaactcaggtgaaagaaatcaaagtaaagctcaatatcgagaatgatagtccatgttcatgaatgggaacactcaataatattaagatgtcaattatcccagactttgtctacagatttactggaattacaatccaaatctctgcaagtccttttgtagatatcaacaaacagaagctaaaatataagggaaggacaaagaccttcctagaattggcctagaatagtcaatacactactgaagaagaacaaagttgagcccttttattaccaaatttcaagactcactataaagctataataatcaagacagcatgtatttaaaagaataggtagataggtcaatgaaacagaattgagagcccagaaattaatctatgcagagtctgctgatctttaacaaaggaacaaaggcaagtcaatgaaaaaaaaaagtcttttcaaaaatggggctggaataattggacacacatgtaccaaaaaaaaaaaaaaccccagacacaaaccttatacctttcacgaaaattaactgaaaacttatcagggccctaattataaaatacaaaatgataaaacttctagaagtaaacataagagaaaatctagggttttgtgataaagtttttgatagaacagcaaaatcatgatccatgaaagaaaaaattcatacgttgtacaatattttaaaattaaaaacatctactctgtgaaagatacttttaaaagaatcatggatggagctggaggacattatgctaagtgaaataagccaggtaccaaaaaacaaatattgtataatctcatttatatgtggaatctaaaagaaattgatctcatagaaacagaacgaaaaaaggtagttactggggctaaaaacgaaggagagaaatgggaaaggagaagatatggatcaaagggtaccaagtctcccttagactggagaaataaatttaagtgatctattgcactgcatgatggccacacctgataataacatgttgcatatttcaaaatcactaaaagaatagatttttaacattctcaacacacacacacaatgttaagttggtgagatgatgaatgtgttaattagcttgattaaatctttctacaatgtatatatatgtaggtcaaaacatcacattttaacccataaatatacacaattggctaatttaaataaaagcaaggggaagaatcgaaagataagccacagaccagaaaatatttgcaaaatacaaatttgcttaattacttgtaccccaaatatatatttaataaacagctcttaaaactcaacaataagaaaacaactccaatataaaatcgacaaaatatctgaacagacacctcaccaaagcagatacacagatggtaaataaacataagaagatttgctgaacatcattggtgactagggattttcaaattaaaacggcaatgaggcggggcctggtggttcacgcctgtaatcccagcattttgggaggccaaggcagatggatcacttgaggtcaggagttcgagaccagcctggccaacatggtgaaatcctgtctctactaaaaatacaaacaattagccggacatggtggtgcatgcctgtagccccagctactcaggaggctaaggcaggagaatcgcttgaacccaagaggcagaggttgcagtgagctgagattgtaccactgcactccagtctagttgacaagagcaaaactccatctcaaaacaaacaaacaaacaacaacaacaaaacagcaatgaggtactattacacactaattagaaaggcgaaaacgcaaaaacaagctggagataccaacgactggggaggaagcagagcaataggagctctcactcattgtttatgggaaggcaaaatgacatggtcaactttggaaggcagtttcatggtttcttaaaaagctaaacatactttcaccatatgatccagcaatcactttcctagatatctacccaaaggagttgaaaccttacatccacacaaaaaatctgcatgcaaaagtttacagaaggctgattcacaatcaataaaaactagaagtaaccaagatgttctacaatatgtgaatggataaggaaagtgtggtgtagccatagaatgaaatattgtttagtaataaaaggaaatgagctattaagccagaaaatagatggatgaatcttaaatgcatgttgttaattgaaggaagcccatctgaaaagactgcatactgtatgatttccattatatgacattctgaaaatggcaaaaacagtgatcataaaaatcaccattttcaggggttggggagtgaataggtgaagctcagaacttttagggtggtgaaactattttgtatgacacaatgtggatgcattacactgaggataaaaagtaaatcttaatgtatgtaaatttaaaatagtatttaggaggccagggaatcctagaatggaatgcagaatgtgacaaaaccaactttattaaaaatgcattacacaacctcactgaagagggagggaaaaaggtgctgacataagcaactttggaaatgagtctgtaagacacagtgaaaagaaactgtacacagcactgccactgcattctagttaataacactgtttcccactggctacaggttaaacgttctgataccactgtacctatagagtagaactgaacaacgaattggatggttggtggaaggcaggagccagatttaccactgttggagtgggcatttacagataagtaagggaaaagggctggaatgattcgtgtggcaacggattagagttgtagacattagtatgaattaatatttggctgaatatagacatacactgttaaatatagaaatatttatagatatttgtgtatgacctggattagtatatacaaatacattaccattctctgtcagctagaggactcagaaacagtatcacagtagcaatgagcactagtaatgcccagacattcgtttctaataccattgtctaataaaaataaccagggctccttggagaagtggctgattctagtgacaggaaatgtacaagatgagcctgaggcaccttgtagtgccataaaggaaatattccaatcgcatgctcgtgcaggcgcacacacacacacacacacacacacacacacacacacacactaatgggggtgtggccaaaggtgcacagagccactgaagatcacccagtggccaaagctggcataatgtgagcaaaaataaataagagtagtattgaattataacccaaaatatcatacaaatattcataaacccatgctttatagttaaataataaataaatgaatgggtgagaagagacagatctcccgtagagcagaatgttaaaaatgtatgcaaacgctctgccctcaaggaggtggaacaccactcctcactccttcagtgtaggctgcatgtagacgcctccttacaaagagtacagtatgcaaatgagaaaggataatagtaattttactgtggagaaacttgacaaatactccctcaggccaggaaatcccaacctttgcctggctggatttcagaattgctttagagcagcaaatcctttgtgcctccagttctctctttatggaacaggtgtgcctacacctgttatctaatgtccatcccaccattgtatgttgaatacatgtgagaaactatcttatctcttaacttttacatatctaaacatggaggaaagctatacacaggaagtacacccgaggagcctccttcacacatgaaactgtttctgatgatagaattctagactttgagctgatgctgtaatggaatgacttttggcgatcttgaaagaaagtgagtgtatttcacatggggagaaacacaaatcattggaggccagagggctgattgtggaaggctgctcctgacaaggcttccaacaatcccatccacctggcattcacattcttgcaaaatctcctccacttgagtgtgggatgaacctagtgacttgcatctaatcaattgaataaagcataagtggtgaactgtcacttccaagatcaggttatacatgattgtgatttccatcttgcttgtactctctggctcttcttgagtacttgccctgatgacactggctggtgacactcacatggcaagaaaatgaaagtatcctctgaccagtggcaagaaagaacggcagccctcgctctagaggcctttgaggaactgaattctgccaagagccacacgagttaacttagaagcagatccttccctagtagagccttctgatgagactacagccccagatgaaaaattcattgctatctagtgagataccctgaagcagaggacagagctaagccatgcctggattcaagatcctcagaaactgagacaatagatgtgctttgtttaaaaccttcatgttttcaaattatggatggtccccaacttattgtactttgatttacaattttttgactttataatggatttatcatgctgtaactcgttagttcaggaacatctggacttatgatgggtttatcatgttgtaactccattgtaagtcaagtagcatctctatttgctatgcaataatagatacctaaggagtttaaaaattgtactaacgtcttgggaaatgatttggcagtttctaaaaacaaacaaacaaacaaacaaaaaaacaaccctgcatctaccttaggatctaataattccacttccacatatcaatacatgataaatgaaagtgtgagttcacaaagaaaaaccctgtacatgaacatttaaagcagcttgatccataaatagtcaaaaactagaattaacacatgtaatcatttgtaagagaatggataaattaataatggtacatccatacaatagaatattatttaacaataaaaaatgaactgctgagacatgcaaaaacatgatggacctcataaacattgcattcagtgagggagttcataatgcatgacttcatttatttgaaattctagaataagcaaagctagtctatggtgaaaaaatccaaacagttgttgattatgggggtagtttattgtgaagaaacatcctttggggggtgatggcaatgttacctgtcttaacaggggtatggattatacaaatatacataactgtcaaaactgatctgttcattttactatacattataccacaattttttttaaaaaaggagatggcataaaagaaagcaaaggaaaacatagtgaaaccccaaattcacaatgcaggaaatttcaggaagaaaactattcgtgccatggaagaaaaaattgctgttattttactaaatcataactgattacatcaaagtcaaacatattgtcacataagtgacataaaatcaattagacatcaatagcatgtttcttatctttttctgtgcaaagtgttcaagcttgattaatgaaatgtctttcctaacgcgagggtgagtcatcaagctcgagatcatgatgagctcctctcagggccactgctcagcctgctcccttcaatccatctcaagggccctctcttctactataatggagctcacagtcaaagtgggagaaggaaaatacacaagtaatcacagataaatgcatgagtagttgttagccagaaaattggaattgagcaatagtgtctgtaaattaatgtgaagtgctagcaattgttgcaggtagttggtagtaacagctgatgaacacctactactatgcgaagcacctgctgcacattagtatttctgagcctcagtttcctcacgtggaaaggtgcagctataacaccgaccttacaaatgtaagaataaatgagagaaataatttgcccaaggatgtgcactaggaggtggcaaagccaagattccaaccagcatctgcatctacagccaagctctgcattacgctgatctccaagctgagccttcatattcatctcaggagtgacttttgaatgtcttcagcagccaaaagcaaccaaacacaataatttgttttacaaaatggtgattattccaacttggaattgggaacattaaagaaatgaccatgaatatcagcaaataacggaagaactaaaataaatctcccttttacttttaaatggacaatgtaaggggatgtacttttttttttttttttttttttggagacggagtctctctctgtcgcccaggctggagtgcagtggtgccatctcggctcactgcaagctccgcctcccgggttcacgccattctctcgcctcagcctcccgagtagctaggactaccggcacccgccaccacgcctggctaattttgtttttgtatttttagtagagacggggtttcactgtgttagccaggatggtctcgatctcctgacctcatgatctgccctcctcggcttcccaaagtgctgggattacaggcatgagccaccgtgcccggccaaggggatgtacttctgttaccaagccaacgcacttgaggaagaaagttcagctctggtcctcataaattagtctaacttcttccttcaatttatacaggctaaaaccaagattttgggatggtgaaatagaaaccaaattatgtggtttgattcccattcagaatattcaaactcaactatatctgcctggataaaatttaacattttgtcaaataatatggctgtattctaacgtgcccttggtcccctgttcagacttgtgatcctagaatgttgcaatgcagtcttcatgaagcagctgctcttttttgactgatttttcctggttccctggggtcaatttcttttcacctgtgtctaaatgccgactaattagatcatgacttcacaggtgccaaaagaaaaagaaagaaagaaagaaaaactcttgggaagctgcagagacttctattgcagaaaggaatggatgtactctgttgcccttccccaaataccgccctggtcaagccaattgggccgccaaccaatggcaccgaccgggcctccgcgcgcagcgcctgcccaattgacagagcgctcgcatccctcagctgtagctcgtgcagcctgtgctaacgagcccgggtgccgtcccagctcctcctccgcccactccactgtctctctttcgcctgtgcagtggttcctggcaaaacctcttatgccacctcccgaccatcccgggaagatttggcggctggagccctgcgcaggagctgtaggcaagagtgggcgccagtccctccttaacccctgctgggtgggtggggtgccggagtccgcactgatgaccgctccagcctgagcttttgagggtgaggggggtgtggaaagatccgccctggagcgagcgcgcacccgtgggctccttgcagcggtggctctgcctggtggcgcgagggcgtgagtgcgcgcgactccctggctttcgcgggtttccccaccccttgcgcaggaaagagcctagtcctgcgtccccctggctctccccacacacacctccttggagctccttttgggtttgctcccgcttctggtcttgagcgtcctgaactgtttcccggggaggcagcactgggcagagcgccctcggagccgctggcgccggcccggcttccctccggggtcccagcagctgcttctccttctccagctctgggctgcggattttaccgcccctgcacagaagcctgcagcgtggaggctcccctcgcgctcgcccagactcggctgcagaaggaggacccacctcgcgtctcccccgaggcgcgcacctctgtcgccaccctccacgcgcctaggaagttttgaaggtagagaatctgggcccctcaacttcctctggacatgaatcaaaccgcaggagtctccaatagcgtcaggtgtcccccggggaaaggccacaaggtaagggaccagcgacggagggggcttgtgcgggggcgtggggcgcagatggaggctacagttggccggagagtggagactccggcaggtttgtggagggagtgtgagcagccgctggtgcgtctgcatgccttgcaggggtcggtgactgaggatggttggcggatcgcgggggttgagagaacgtgtgctgttttgtagacccgcggccagcagcagggctctgcccgtgcatccgctcccgccggccaccctggggctggagatcctaccctgctttgcggctgggctggcaggtgcagctgtttcccatgattgcgaggctttcgggagaagaggtcggcgttgggaggcagagcccctccccctttcacaatcagacccccctgggccagagcttgcagaggagctctttcccgggaagcgcgcgcggggctctcccgcgggcgctggcgctggctgctgtcacggacacgtgcttcattaactttaatggagcgatgcgtgcctggaattatttccaggaaattagtgacgttcagagaaaggggagtgggcggcggcctaaggaattctggcagaacctcactagcagcccagagtgtgagggacttgggaaacgtttactcccacgcgcaaaaaacccagatcgccagcgaggttccggatttcgcacggatcctgtggggcccggccacccttggccatgctcaatacgcctcacctgtctgccattccgcttaggttgtgatgaattagcgaggaaattccttacccgggttacatagggaagccgcacagcaatgcatgtaacaatgaactttaaaatattttcgaatatttatatatttttttaaatcgaaaaaaggcgagcactgtggagcttagtccttgatatgcagactgaatttatgctttactctgtcatcttattttcgacacctatttttgtgtgtacactttatgtaagggcatatatgtttattagctcttattggaaaaatattcccattaaaatctacttgttggggtttggggcatgtattagcccacaatatcaactccaaacactatctacttgttcggagttgaagtgagtaatgatattggattcacttggcagataaaggaattcttgttctgtttgagttatgtaagatgaggatttaaggttgaatgcttttattcaactgagtaagtaatatcgagcattttcttctatcagatcatgaagaaatatttgaatcagcaagtcatttctctgatctctgttctcactatgatttgagtagttatatgtttcacatttacattacttaatatctacaggaaatgtattttaatacagagtagttgatataaaatttttcaattaaaaataaagtttcacccatcagtgataatatagtagagacatctgtggagttcagaagatcattcaggaattttctttaagaaatgtctttggctccagtattaaagtggcttcttggaagaattggactgtagagtattgccaccaataaaactttctggaaagtgttggaacacacaccaacaatttaaaaggtactaggaaacctgttaatcatgagttagggatcaccttacatacctatcaggtgtccaacaaatacttgctccaatgaatcatattaattcaatagtcatcaatcatccatttaataaacatggtaaacccctattaagttccaataatatgagaacggagagccgcaatatgaacttagacattgccttcactgtccaacatgcagttctagtcataccctatccttccttctttaaaatctttgatggcctaaagtgagatgatggtgaaatccattagctagaaggaaaaaaaatattcagttccttttctcaaagaagaacacacttaagttgttgtttgcctgtaaagtttgcagctttggagtttgtcttgtaggttgctgtggtgcgataacatgagagactgaaatgattggaggtgacgtgttggtgaaagttctgtagtggatgagggatgagctggtagcaggagtcaacagtcaacactgggaagtgctggatggaccatgtgacatttaggtcacagtatttttccaataaaatataaaactcaacaatgtcagtttagtagatgttttggaacagttgtttttccatcgtatatatagcatatacgactttggtggaaggaaaggcatcagcctcttaggaaaatattccagctggactcacttttgtttggtctcattcatttactgattactggtgtagcaatttacacttggcaaattcttatcatttgttcttgtgcagatatttcttgagcaacattggttgtctcttttagatggttattcaccttttagatgtgttagccttcttttagatgtgttatttattgctaggttcattcttgcctattgaagccctagaatttggaaagaagaggtccttgttgcagcctcctttctcctgagcatgggggcacctgaccacctgctaacagctgctgaggatcacagggtaatccaccacactgttggccccagtagaggcaggagccactggtcctgagaggaaacctcctgaagtgatagtcctctggaattggctcctggaaacttgtaagtggtattcactcttgagcaaagaatacaaacttaagttttacagaagatgtaaactaccaacataagactgttcaactttagctttggaagatggcactcaccttctgagcagaaagtaaggacacccagttgagtagttaactccagccaaagtagggcctctcctttcagcctcaggtttgaagagaaagcaaaggtttggattgagtttctttgcttagagcttttctgaaagggaaatttccttgtatcagtatgtattacgttagacatcaagacaagtattatcagtgcttcagtctctggaagcagcagacatagctgtccaaaacttggactttgggatcctaaggtaccagtgtcattttggataagttgcttaacctccatgcctaagttttataggaccttcatggtaggagtttcatgaggattcaataaactaatccatgtgtggggctcgcagcaggacctgccacacaagatgaggcattactttacctttgagcacccaaatcagggaggacaaggcaacttcactttaaaaccctttttattaagggggagcatgtgctttataaatatttgtaccacagcctctttttttttttttttgagaccgagtctcgctctgttgccaggctagagtgcagtggcatgatcttggctcactgcatcctccacctcccaggttcaagcgattctcctgcctcagtctcctaagtagctaggattacaggtgcgcaccaccacacccaggtaatttttgtatttttagtagagatggggtttgccatgttggtcaggctggtctcaaactcctggcctaaagcaatccacccacctgggcctcccaaattgctgggattacaggcgtgagccaccatgcccggccaacagcctctttttacatggtcgcctctcataggcacacagctcctcaggagcaggtcccagagggtatgagtaggatgggataattgttagagtatgggctttgcagtgagacaaatggtaacttggtaaagatcacacaaatagagctgggcatggcatggtggtatgtgcctgaggtcctatctactcaggaggctagtgtgagaagatcattgaagttggaatccagtctcggcaacacagtaagatggcatctctaaccctcacccccacaaccccagaaaaaaatcacacaagtagaaagtaacaaatgcaggacataatttaatttatttttacacatctggaaaaggggaatataatgtatgcattatctcatataattgttaagaaaatccccatgtaacagtttgcatatagtaagcatttattacatgacaaagcttcacatcaagcatggatataggtcctggtaataattctttgtattacttatattataatttgagaccccattttatctaaaattcttcgctctatctgatgttgtaattgtttatatttcatatctgttttctcttttctctgctttcaagagtatctccttatctttgattttccatgtttggtgacttgtatgtgactagccatgggttcttttatatttatcctgctaggagttcactaagcatcttgaatctttaattctttcaccatatttggggattttgtaccattattttcaaaaatatttttacattttattctttcttgggatgacaattgtatatatattacacaatatacagattacatattatggcctacaaatgcatatagcatttacaccatttgataattaggatcaatataacagattccatgagcactttttccagcttgtaagattcctttcctagccatttttgccaacaaggaatctagctccaccaggtccgaaaaaactctcaattcagaaacatacttaaagagtaatcgttttgtctgagggtagagatcaaaagtctctgcttcctatttgtgaaggtggatatttaacattctagttttcgttctcattccacctttgtctccaaagccaaaagggatgagttattagtccatgaacctcaacggattctttgcaatgaagagtagatgcaaaactttggctctgtggatttcaatctgaactcaactaacgaaatcccttcaggatcaaggactcacttggtgcctctctgatgaatgcagtgattaataatcgtaatatctcctgtttacccatttgcgctcctagaatgtggcaagaagtcaatccttattcatcatttggcaccattttctggtgaggaacatcgtattctaccaatgaattactaaaatgttggtgtttcttctcaaggttttcatgctgtgaaaaagctgatgaagtgtttgcattttgaagttgcttatgatccatgaagagtgtcagcctctacccacaggagtttgctgacttttgccagctctaggtattacactttgtggaaatttaatagccttcttaccttctacttctagtgtttattttaccacaaggacagggatagcaaagcttgtatgtctgtcattttccttttaggacattaaaaaaaaggattaatcagctaaaaccattttgattcaatagaaatgcatttttttttgtgtgtgaaatactactcatgaatcccacctacatttttactttgatttcatccttaaaggatatattttcctggatgtaaaattctgagttgacagaatttttacttctttttcagcactttaaagatggcattccactgagttctagaatgagttttttctactgagaagtgaagtcatttgattcatagttccctgtatgtactgtattatttttctttgtctgcatttaagatttttctttggttttcaatatttcaatactatgtgcctaggcatgattttcttcatatttattaccgtagtgggtgcaaagatcaccttgaatctttaaatgcaccatctttgggaatttggtggccattatcttgtcaaactttttttcggtcctattcttaatttgttgagatgacaattatgtatgttttatacagcttatattgctttacaggtctctgaggctcatcatttttccaagatacttttctctctctttttcagatttaatttctgtggttccatcttcacatttaatgagtctctcctctgtgttctgcattctgtggtttgtgtgcttagctccggatattgcattttcaaattctaaaatgtccacttagttctttctccataatttctattttctgcttggattgtttttttttttaattcaccgtgagtatctttgctgtttaataaatgaggagtcttcttataatactttaaaactcttgtatgataattctaacatctgagccttcttagaattggtctgtgttgactgtattttcttctcgaaattggaccacagtttaaaatgtccttgtatgttgagtgattttgaattttatcttgggcatcatgcttgttgtggaaactctgcattctgttttgtttctctgatgatttgtttttcattttaatgaacacttaagttggatggcaactcaaatacaagttttgttcttttatcctcttgtagcccattcagcacctgcatgactcaggggacaactagagatttggaggctgcctagttttcttaattctggaatcccttttcactttccaagtgagtcctcttcaagactttaaatctttgtgaagctttcttgttgaccttcactcagtctcttttttattttctgtcagttctttctctactcttctttcattttcccagtgttacattttccaaaactcacattttgataaactatcacttgtcaaatctgaaaaatctgaaggttttcatgccctcccttttttgtcttctcataagaagcaaaacctactttaatgctctccctttgccaaaatacctcctgtctccttttctattctttcctgccccttttggtttagatccatagaccttcccccttctggggcatttcatcctatttccgaacttttcctcagtctatcctgcttaggaattgagcagcctcctcctcctcttcatggcttaaagaatttccctcctggattttagcactgattccctttctgtgctttccactttccaagtgagtcctcttcaagactttatatctttgtgaagctttgttattgaccttcactcagtctcttttttattttctcttctctttctgtaggaagccctccctctaaatgattagatcagccactgactcacaggctatgggacatggcaaactcatgcaaggcttatggcgtttcaccagttgctgccataacagcaggtccttttcctgccccttttcttttctcacacacttggcttcagaaccaccatctatggacatgagtatatcacagaaccagagtcctgctaagaagggaatttttttttaataactcatggttgcaggtaccattctccagcttgattttggacttgaatcagaccctcccacctactctgatccctacacctccctgttcctgagcctgtagttctttctgaattcccaggttccctcatcctgaccattggtatctgtcgttttccacatagtgtctagttcctcctatgctggagaatctttcatccctaatataacatatttaaaattaggatctaactttagaggtaatttcatttagtcctctcatttcaaaaaactgagatccaacaaaacgcagttaatgagagagccagggctcaaacccccactgcctgattctaggttttggcacattccattatacgaggctgttttgtggttcatcttctccatctgagcacgcagtgaagggccacatctgatagacacttgggcatcatgaaggttagtgagtcagcctgaaggacacttcactaacacttgctgttagcaagggcatgtctagttcataacttttcttatccaccattgctcttcattctgaaaagaaagcttagttgtctaattggtaatttctggaagaaataagaaagagtacccgtgtaaatataaataaataaattctttttatcacccaaaacttaaatcatccccaagtatttcagaaagtttaatataatggatagaacataaattacttttatgacttccaggatattactgaaaatctatttatgttattttggctttacattttattgatttttaaaattttaattgtcctcattttatcagtaaaatacataaaatgaatctaagctcatacataagttaagtttccaggaatagagggcagtaaatgagtagtaactgttttttctggttttatttgttggattttttttaagtcaaaagttatacctcaaatgcagtatttcaattatcttacaccttgtacctcatgaaggaaatagagtgattggaattttataggaccctcaaatctaatatttttattacagtcccagcaatatggatttagtcaaaagagatggaggaagttatgtaatttcttgtgcatgccctccctcatctttagggctttagaaagtttgtattattttcctattatggagacataatgtgtctgttctttcagtgtctgtatcttcctttttatgaaaatttcaaatgcaatattaagagatcataaggcatttaggcattatgagacattttaaaattacatctgacaaaatgtgcgcacagcagaacaagttcatatttttcattttgtttttcataaaccaaaaaagctgacaattcactggggcctcgtggaaacttcttaactgtgtgacttcatacagaaaagctcatccagtggcggatggtttactgaggtagagtggaaggagggaaacggaatcagtagactcgatcttagcattggttgagtggggcacctgttttgtgtcaggtgggtgggcaccgctctctgggcctttgttcacctgtgtgaaagctgaggacattcaaccagccttcagggtcacgtcaagctccaacttcacaatattccaagcctagaaagaaccatgggccgggcacggtggttcacacatgtaatcctagcactttgggaggccgaggtaggtggatcatttgagtccacgagttcaagatgagcttggccaacatggcgaaaccccatctctactaaaatacaaaaattagccaggcacggtgtggtgcatgcctgtagtcccaactactctggaggctgaggcaggagaatcgcttgaacccaggaggtagaggttgcagtgagccaagatcgtgccactgcactccagcctgggtgacagaatgagatgttgtctcaaaaaatgtaaagaagaaagaaagaaccataggcagagtgtttgctattattaaggcatccattggcatagatatcaaaaactatcccatagtaaaacatacttaatggagaacctaggccagtagatgtcctttagacttcagtgtaaaaattatgacctccagcaagtcctttagggaaagggtgccttatagttgctaggctagtcttttcagggactcttaattggtgtttgtcatatttagtgagtaagtactaaactcattgcataaagttataaattattgaagtcagctaagtcaagagatggtgtcttaaaagcaggacaaaagaagattattacctcttttgttcttgaaaaagatattgcaaacactggataccatgtttaataagtacattgaggtatagttgactgtgcatatttagaatgtacggtttaataagtattgacgtgtgcacatgtgcatacccgtgaaaacgccacggtcaaggcaatgagcatatgtgccattcccagaaggtgcctcatgctcccttgtgatctgtttctccctaacaattccactacctttttccatccgtaaggaaaaccgatcttttttttctgttactatatattactttccattttctaacattttagataatggaattattaaagtaggtggtcttttatagtctgacaactttcactaagtataattatgttgagatttattcatgttgcagcatgtatcaatagttatttatttgttgccaagtaatacttgattgtatgcctataccatggtttgtgtatctattcacatgttgatggacatctgtgttacttcaaattttgggctattaccaaaaaagcttttataaacatttatgtacaagtttttatatggacatatgcttacacttcacttaggtagggtaaatacctaagagtggaacagcaagatcatacagtaggcatatgttcaactttttaagaaactgttaaattattttccagagtcattttagaattttatatttctacctgcagcttctgaggcttccggttcccccaaatccttgcccacactcaagataatcagtcttcaatatgagccatttaaataagtgtttagtggcatattggtgcagtttaaatttgtattttgcaatggctgatgatgttaagcattttacagatgcttatttccatccacatatcctcttggctaaagggtttctgaaaatccctgacatatttttgattgggttacttggtttctactgagttgagagtttttcataaatgtctttatcagctatatatttgcaaagtttcttccagtctataggggtatatagtctataaataaatctttttttttttttgagacccagtctcgctctgtcacccaggctggagtgcagtggcccaatctcggcccactgcaacttccacctcctgggctcaagcgatcctgaaactgcctcagcctctctagtagctgggactacaggcacgcaccaccacacccagctaattttgtgtgtgtgtgtgtatttttagtagaggtggggtttcaccatgttggcaaggctggtctcaaactcctatcttcaggtgaactgcctgccttggcctccgaagtgctggggttacagctgtgagccaccatgcccagccaacaatgacttttgaagatgcttgcaatgtggataaccatatgtgaaaaaaagaactttgatatatcctaacaccatatgaaaatattaactcgaaatggatcataaataaaaatgttcaatctaaaactagaaaaattctagaagaaaacataaaatacctttaagttaggcaagtgctttttaagtatctatgagtttatccttttcatcaaatttggaaatctgggggcactatttctgcaaatatttccctgcttccacttctctctctctctgtttctgtctctctctctctctctctgtttctgtctctctctctgtctctctctgtttctgtatctctctctctctctctctctctctatctgtatgtgagtgagtgtgttctctgtcaggggtttcaagtgcatgtatattaggctgcttgaagttttaacatatctcaatgatgctttgctcatttttaaatttatcttttccctgggttttattttggattatttttattcttatgtcttcaagttcattaatattaccttctgcaataactagtttgttgtgaatcccacccagtgtattttttgttgtgcgcagtatccatttcctctctaggatttcaatttgggtctttttaatgttgtccatgtcttcattgaacattttgcacatatggaattcagctgtaataattgttttaatgtccacgtccactaatgttaaaagttgcagcagctctgggtcaatttcaattgatcaaatgccatccttgaatgagatttgtattgttttgcttctctgcaagcctggtaatttttgattggatgccagatattgtgaattttatcttgtacatgctggatattcgaatattcctaaacctacttcagagctatttttctggtactcagttaaggcccctggaaataatctgattccttcaggtctagctttaaagatttactgggtggaaatgtaatattaattataattaactatgattataattatccctatgctcagttttagggctaattatccccactacaaaaatagggcccttttgcgtattctatgaaatgtccatgaatcatgagattgtttgagagtggcttatctgagcacgtactattttctgtcctgtgtgagtgtcagggcaccactgcctccaatacttccaggttattctttccccaaccttggagagtttctctcatgcgtgccctgttctgtactcagctaattttcagggggccctcagcagatctccaaagctctctttccgtgttgcttgctcctctttcagaccctttagcgcaaactgtagctgccttgttctccccagactctcagctccatctgtttagctcagagtctcctgggccccacctaggttgtccatcatccgctttagtctgaaaactctctaaggcagtaagctcgggataaatgggactctcctcatttactccccatctatcagaaatcagtgtccttcttcgctttctttgatatccagtgtctcgaaatatgttgtttcctatgtttgtacaagatttatttgtttcaggcaggaggattcatccatttcctgtttctctattttgactagaagtgaaaatctctgggaaaatttgttagtacataccttttgattttagaaatcatgactttaaaataaaatgggcctaaaatgtatgagaaattttaaattaggctaaattttatgctgaatatattgaataagttaaatataactaagacaaacccatactctgcatatctgacatgaattatttgaggtctgaagactggaagacactatgaaatgaaaagcttgtcaacaatttgacatttctttctccatgcttccacttttccaaactttttcatgaatgtcaccttatttcatcttgcaacagccactgaggtaaataggtaagtatttatctccccttttttttgactgaggaaattgtgctacacagttacgtgtgtatcacttatggtcaaaagctaataaaatcaagaaatgttttcaaactaaaaatgtataaatattgaatactattcaatcttttattcagcaagcatcgatccatgcttccttcaacccacgttatctattaatttatccaatgccgaatactatttctatacttcataagcattggactccttgctattattcctttaaaaataactaagaaactattatttttattaatgagtccgtgtgtgcacaaacaaggcagaaaacaacagaataaaatacccagggacactgaaaaggaataaatccaaattgtagcattttggttggtcaggggaaagagtggtcagtgtggtttaggtaggaaaggcttgccaaagataatgggacttattgcttactcttctagttacatgtcctgcagtcatagaaatatgcagactaaagtccgtgtaaaaaacattttccgcttccccacatgataactgtaatcctttgcaactcaagggccctatagggttttaatagacagttattacataacattttctatgtttacttctgttaatttgtatttgtaaccacggagaatagattctaattccctgcaatacaggaactctgaagctttacttcccctttacaatggtcaaaagcctgagaaatcataaagagcaacatgatatgaaaaaataaaaacaataaagcaacttttaatatcttcttccatcctatgtaggcttttgtagtggtgcaacattccttacttaacctattcatcaactgccaattggacatctgtgtaatacaggtgttattcattgcttcccaggccacttatcttctaagggattaagactctacccgcctggcgcggtggctcacgcctataattccagcactttgggaggccaaggcgtgtggatcacctgaggtcaggaattcgagaccagcctgaccaacatggagaaaccctgtctctactaaaaatacaaaaaaaaaaaaaattatctgggcatggtggtgcatgcctgtaatcctagctactcaggaggctgaggcaagggaatcgcttgaccccgggaggtggaggttgcggtgagccaaaatcgtgccatttcatgccagcttgggcaacaggagcgaaactccatctcaaaaaaaataataataaaataaaataaaccccacccacagtctcttctctcctatttgaaacacaggactctgtctcctcctagatacacaccaaggttgaacaagcactcctaggggaataaagccactagttgagccatgccaatcaaatcctctcttttggaaacttgaacaaagacatagagattacaatgagaatttgaaggacgctgtataagatactagactgacagccgtgcatggtcatgagcagcccagggatgaccactgggagaagagaaggcggagagcagcagagatcacagaaatcatgaggccctgaaaagtgaagatcccgccctcactttctcactttcctgatgcagtcatgtgaaatttgtctttacttccatttatttcctttccaactctcagtgttctgaaatgtaccattacgtaaaagtgacagaaaatgaagaaaaaccattaattcctagtgggatttcccatttttactctcactcgccattaccaccaaataaaactgtttttgttgagcaaacttttctataagcctctttgcattcttactttgcatcccaggaggtacaagtaagaaaaaaaaaaaaaaaaaggtcttctgaattcttctgaattattttctaagtagaagtgggagtgatggctattttccaggttagtattggttagagctcaccagaactgaatttgtcagaaaaatagagggtatctatgaggctttgtggcgagagacaaaagggaacaaggaaaaaaagatgttgctggcagccaggagatatactttggggagaagaatggaagtgttactgtattgtatcttgcttttttagaaaagtgtgaatagaaatcttctgggtttactaatgtgttatagagctggatttgggcgttttgtggcaattggagttgcgtagtttacgtaacattgagcagaggtgcaagatgggagagacaagagctcagactgcccaacgggtctcagaaaatgtaggttacatccataatacatttgtttgttgtttttatttgagctactttgtataggcatctattttcttgcaatcaaataagctctaacgaaaatgatgtgtaatgtacaaagtaccttagcagcttcaataagcattagacatgatctccaccctttcatgaattcacctgtgttatatgggtaagttagactccaggaacaatcataaaacagccttattcttttctccagctgtccctttagaacaaaactctgtctagttctaaacagaatcacactgatttttgaagataacatagctttttttctggctcttttgcatcacaaatagtatcatttacaaaattaaaatgcccggcctagtctaatataacattattagcttcaggattcattcagagagaaacttttcctctctctgagcttgagtggctgtgggtctggaaacctgcactggggaagggaagacaggaggcccttctcttggcccccttcctggtatgttccttgctcctcttctgcactcgctagtcctccctggcctgttccttgctcctcctctgcactcagcagtcctccctggcatgttccttgctcctcctctgcactcgccggtcctccctggcatgttcctcgctcctcctctgcactcgccagtcttaatttctcacttctccaaggttgggttcagggggaggagggatgagagaaaggatacagcgtcacatggtggttatggatctcatctggtgatgggtctctctggatgtgacaaatacacaaagccgcactttttctcatggggagcttttggagagcttctttggagaccctcacatagaatgttggaagatggcttttagccttttctctcactgtgatgccttcacacatcctcacacttcctgtctttaccctcttctggtcctttggctctattgggtggagttccttacaaaatggctcttgggattcccccatgtagttcacttctggcttatgagaaacacccacattttcccaccatcaccagaaccgacacagcttgcttccaatacagtcccctctcttcacatggggctgcctgagatttttccaggtggggtctaggtagcattgcttatgcttgaaagactctctgttctccaaagcacccgtttcaggctctgtgacgccgaatggctctgtgacaccttctcctttggcttgtgctgagaggaaacctgtactttccttttcctgacccagttgcacagcccttagtcccttcttcctccacccaaaagatgagggtgccagataattccactcactctctatttggaggtttcctgtggattattgtaaatgtgcgctaaccaatttcataccctttattattttttaaataatgtaacaggtcaccttgggctgcagggacacttggcaaccatttttacagcttttaacttttggtgcccgggccgggtgtggtgtggtggcccatgcctgtaatcccagcactttgggaggccaaggcaggtggatcacctgaggtcaagagttcgagaccagcctggccaatatggtgaaacctgtctctactaaaaatacaaaaaattagccaggcatggtggcgggcacctgtaatccctgctacttggaaggctgaggcaggagaatcccttgaaccagggaggtggaggttgcagtgagccaagatcatgccactgcactccagcctgggcaagaagagcaaaacttcatgtaaaaaaacaaaaaaaaaaaacagaaaaaaacacctaggtagttgatgatgtatgtaaattgtcagtgctatctacattcagggggtatatcaggaggatgtattttggtttatgtgattttaaaaggattcacggcagagttgaggtttcagcagagtagtggaggacacagcttcttatttgagactttgttttacctaaaaaacacatgtcgcctcaccaaagtggaaaaatctcattttctttacacaccgtactgcaattgcttgtgtactcatgcttatggaaagagggaacccttgaatgacttatccttttcacaataaaatcctccccctgttgcaatgcttcttctcaaacatcagtgtccacacaaaccatcttggtgttcttgttaaaatgtggattctgattgagtaggtctagggtggagcccaagattctgcatttcttacaaagctcccaaatggtgctgatgctgctggtcctatgaccacattttgagtggtaaggctccactgcttttgctgagtcatatgtaatgtactaaataatacattttgtcatttatgattgacaaatcagtcgaagcctttcatttcgtgaaaacggtcttagtggtagtttgcacataacagcctctcatttctttgaactggggttagacattttggtgccattcatttggaaaggagacttgaaataggaacaaagagaatgaggttcccgttgtcagctgtgctatcgacttttgctatgtggccattaacaagctttatcatctccaaactttagccacttgcattgagtttttgtattaagtagtctccagaggtctagccaataccaacgttctatttctagatatattttatgtttatcttatctactcagctatatcattaaaaagttgggaactaagtttttgtttgtgcctgtattttcctttctggaacaaacaatagaaccttgccattaaacatgctcaataaatgtttattaatgatgatgctgcagagctttgacagtgaagatacaagagtgactctaataaagaatccatgagttttttttaatctagcaaatttatattgctgaatgacatttacttactaaaattcaaaataataaattcaataatattcacacatgctgagtttctcatccctgactttagggtaatagaggcaacctcgctagaatcaaatagtaacagtaaaaaagagctacaatctgtatcattataaaaacaataaaagttttttaaaaaaacaagcaaaaaccgaaatatatttcctggctcacacattttagtgattctgtatcaatgaaacgtcttcttctctttaaggtataccatccatgtcacaagccacataataatttgaaaaaatcagtgactgagctatgagttaccattctatggggttgtgggttgtggggccctaagttgaggaaagtcaagaaaaagattgatggaaaaggcagaatgacctagttagtctttaaatgatgtgttattacaaacaaggaaatgtcactataacatttactagctagaaaagaaggaagtcaggggtgaaaagtaaatggtgtgtgaagcccagaaattcctccttgattatccaagtgatgctgtgaggcaaacgcttccacttaccaagaagagcagaaaaatgtccactttccttctaccagttacattatagctcttattttaagagacaaattgtgtaaaatgctacaataaatgcaattttgatgataaggacagaacattcaaatctaaaacttatgtgttagccaactttcaaaaaagtgagaaactttttgttgttgttgttgttgttggattcactcttgtcgctcagactggagtacagtggtacaatctcggctcactgcaacctctgtctcccaggttcaagtgattctcctgcctcagcctcctgagtagctgggattacaggtgcctaccataacacccggttaattttttttttttttttgtatttttactagagacaaggtttcaccgtgttagccaggctggtcttgaactcctgacctcaggtgatccaccctcctcagcctcccaaagtgctgggattatagccataagccactgtgcccagcctaaaaaaaagtgagaaacttttaaatgtgtgtatcacatattgtgggaaacattgatgtcttattctggacaagaatagctcaaatgccacacatttttaaatgtgcatcattccacattggagtttctttgcagcactattgtgttgagggctctgtatgtatccattgtgttgtgttttataaaatgaatacctggaacggatgtgtccccgtggcaggtggggcagcacctgggtggtgaagaaagtggggtgagtcaaaattgagacaagcatgaggtcttttaagaacttgaaaagtatttcaatatctgaaatagaaggctcactgttagaaaattgataatggaactagggttgcagacaaaaaagtgtttgaatctaggtgtagaattctcatccccagagggaataagctagaaagttagttcatgatcaataaaccaacatctagacaatatgaagatagagtttaaaataaataatgtacatttactgtggaaagggaatttttaattttctattgttaagtacagcaacctgggaaaagaaaaagaagttcttgatggtaattaggaaagaaaaagaaaaaggtttatccatggattaaaggagagggtaccatatgccagaaacatataatattttatctcacttaaccgtctcagtaatctcaggaagtgcatttgtaaggagaactcagagatattaagtaacttgcctaagatcacgaggttcctttgtatgtctgttcgttcacatgtaggcatgagatcagctttagtattatactaccaaagagtttttcaaggcagttgtgctggtttatataagggcttcaacacttgatgttatcacctttctggatgtggggcttcaagtgaggttatggaggtatctcagtgtggttttgctgtacgttttcttgatgactagtgaatattaaacacttatgcttattggccatgtatattgtcttcaaatcttttgcttgttttatttttagctcagttatctgtcttttgaaaaaatgatttttaaatatattttgaaaagagttctttgtcagatatatgcattgcagtgtatttaccacctatgactactttttcagtctcttaatggtcacttttgtggttaaaagctcttaattttaataaagacaattttaacaacaacaaattcagacctgggcttaacacccaaattctatgaatctaataggttaattctaacaccaaactgaatagtaaatagtgaaaaggaagtaaattaatcaaaatgtccacttagcaatttggtcgccagttaaattggcctttgagtaaataaggttcttcttcattatcggaatggtaccatacagtagaattgtcttcctagaaattatggctctgatttacttgctgaaagatcattgattttcataggttggtcttgtacccattgatctcaaagctttctaattagctgtaattatgagtttttgctgattttgtacatgagattgtggtgtccacaaatgataacagttatatcttacttcctgtaccttgttgttcctgtttattttttcttatgttctttatattgtgtatatttaaggtatacaaggtgatattttgatatatgcatacattgtgaaataatagcaatcaagctaattaatacatctgtcacctcacacaatcttggtcaggacctccagtactatgttaaacagtagtgtttccagtgaaagttactcaatattctagcatagttgggacacataatggtgtgatttactaacatagggaagaaagagaaaggaatagtttggaggaaaatgtaatcatccctgtgataggaccaagtaaagacagtagggagctggccatgaatgtctctagctctggaaaggggtaattctaggagatttaaacttgggaatcatcaactgacaagcattaacttaaactgtgaggttactttccagtttctgctcaggaagagctggagggttacacccaactttaaaacaggagaaaaaaagccagaagtgtgagctcctcacttttttttaaatccactaaagagaagatattgcaggacaaccaagtaatccaaatctaagaagagataaaagactacaggctgaaatagggtttgaacacacttgcttagttgattcagatcaagtcagacgtcaataggcaggactcagctggaataacaggtgaattggtagaggtcaagtgtgggttggtgagggacagtggagtccctgggggctgcttctatgcggagaaggcagggttcatattctcttgaagactttttctttgtgaatccaggcattcacagggaagcctgggaagagtgcagagaaaactttctcaaagatgctgcctgagggaggggagaaccagcctctgcagtggagatgctggactcagcctggactctactgccccgtgtccatgaaggaataaaaagtcttaatctgccgtgggaaagagaacaaaagctgtcaccctcaggccgagatgaatactcattgcaactggtgtatgaaaatgggaaaactcatctatcccagagaatcagcagtaatatattctaggctcagaaccacagcagtcagaggagaaggggcactcctcaaagccacactcccaagaccaaagaacatagtccctggctgaagccgaggacaaagaagaacaaagaacaaagaagaatatcctaaacccaaggtactgataaatctgaggccagtggtacactcaacataaataaacaataacgaatcccaaacccagcccaagacctaactagattaaaacaaacttccacaagaaaggccaaggagaaggaaaaaaaaagccaatttccaagcacaaaactgtttacctcactctctactattctacaggagatgttcagctatcaacaaataaggatgaggaatatggaaaggcaagagacaaagcaatcaaaagaaccacttagacacagacctgtctaacagataatttaaaataactatgactatgttaaaggcatgaatggaaaaggtgaacagcatgtaagaccaaatgggctattgcagcaactcaagacaggaatcaatggaaatgctaaaaataaaaatgaatataaatgtggataaaatacacttttgacatgctcaccagtagattaaaaaccattaataaatataaagatggattaatagaatttttacaaaatgaaccagatataactaaagcaaaaataaaaggaacagagcatccatgagttatggtacaatgtaaaatggcttaacataggcattattgaaaccccaaaagtatgatagagatttgaggagaagaaatgtttgaagaaatattggctaagagttaattagaattaattggtccaaaattaattagaaaaaccacaccatggatctgagaagttcaagaatactctataaataaatgccaatataagtgcatttgtgtacacagacacacacacataccatgttcaattgctgaagaacaaaatatgagaaggtcccaaaggcacccacagggaaaagaaagacacaagaggggaacaaagataagaattatagcagactttttgtcagaaatcatgcaagacgaagacaatgaagtgaaatgaaattattattattatttttttgagatggagtctcactctgcctcccaggctggagtgcaatggcacgatctggcctcactgtaacctctgcctcccaggttcaagtgattctcctgcctcagcctcccaagtagctggtattacaggcatgtgccaccacgcctgactaatttttgtatttttagtagagacaaggtttcaccatgttggccaggctggtctctaactcctgagctgaagtgatccacctgcctcggcctcccaaagtgctggggttacaggcatgagctaccacacctggcccccctgaagtgatctttttgaaaggctggaaagaaaagagtcaacacagaattttatacagagggaaaatatctttcaaaaatgaaggagaaataaagactttgttagacaaaaagtgagaaaatgtattgccaatagacctacatagcaagaaattttaagagaaaaaacatattaaaagaattccttgaggcagaaggaatatggtaccagaaagaaacttatatctacacaatgaaacaaagaatatttaaaaagaaacaaaggaaaataaaattagttttttatacctaattgctccaaaagataactgattttttcaagcaaaaattttagctctatagtgtatttatagcatggttaaaaggtatctatggtgtagggatcttataacagtacgttcccagttcctccttcacagcatacattgttgtgatccttacacttcacaggaagtatatataaatacagtctcactctgttgcccgggctggagtctagtggcacgatcttggctcactgcaacctccacttcctggactgaaacaattctcctgcctcagcctcctgagtagctgggattacaggcacgcaccatcacgctgggctaatttttgtgtttttagtacagatggtgtttcaccatgttggccaggctggtcttgaactcctggcctcaggtcatctgcctgccttggccttccaaagtgctgggattacaggtgtgaggcaccacgccccgctgggagaataatgttatttaaagttagatgttgattaattaataatgcatattgtaaaccttagggcaaccaccaataaaatgtgtaaacatgggcataagtaataggttgataaaagagataaaatgaaacaatgaaaacaataagcaaaaatcagaaaaagaagaaaaaagaaacaaagacaaatggaacaacttgaaaagagctaggacgatggtagattttaatccaaagagatcaactgtaatattaagtgtgaatggtttatacatacaaattaaaaggcaaagatggtcagattggattaaaaaagaaaaaactataagctctttttgagaaatccaacttaaatataaagatttagataggttaaaagaaaaacaataaaatcattaacacaaagaagctggagtagttatattaatatcatatacaagacttttgcctctgatataaaagacttttgcctctgataatttttcttgtttcttttatattaatatcatagaaaagacttttatatattattatataataatatataaaagaaaagacttttatatattatataataatatataaaagaaaagacttatatattatataataatatataaaagaaaagacatatattatataataatatataaaagtctttgatattaatataaaagtaacaagtaaaattatcagaagcaaacaggggtattgcataatgataaacgaggaatttctccagggaggtgtaacaatactatgtatgcgtgcacctaatgacagaacacacaaaaccaaaaatttaaaaaacccacaggaagtcaaaaatttttttaaaaaagacaaatcctcagttgtggttacagactgaaactcttttctttcgtgtgtgtgtgtgtgtgtgtgtgtgtgtctgtgtgtgtatgtgtattttatatatatatatatatatttttttttaaagcaggcataatattggtaagaatttggaaagactactgttaactcaatttacctaatgacatttgtaaattattatgcaagaacatctggattattcaccaagacagactatattctgggccataaaataaacctcaccaaatctgaaagaacagaaagcacatgaaatatgatctcaaattgctagggatttaaattagaaattaatatccaataggtatctagaaaattcctaaatacttggaaattaaacatgtttctaaataacctgcatgtcaaaaagtttcaaggaatttaaaaataatttgaactacatcaaagtataaataaactatatcagaatttgtgtaatgaacaaagccatgcttagaagaaaatttatacaactaaattcttatgctggaaaagaagaaagatcttaaatcaatcatctaagcttccctcttaagaaacaagaggaaaagcaagttttacccaaggcaagcagaaggaaagaaataataaagatggcaacaaagacaaaaaaaaaaaagaaaataaaaaaatcaatagagaaaatcaattaaaccgaaagctggtaatttttaaagatcaataaaattgataaacctgtaactgaactaaccaagagaaaataaaagacataaatttaaaatataaaagagaaattaaatgaacaattctatgcccataagcttataaaaggcataactaccaaatataactcaagaaataggcaagcagaatatgtttgtaccaattatgttgactgaaattaaggctgtttaggcagaaacaatttagtaaaggcttactggaagccaaatatgaggattgactggggaagacacatcagcaaagtgggtatgttccaaagtctgctacaagtccgaaggcttttataagaaagtttgggagaaggaaaggtgactcctcatatcagagttgtccttttcaccggaaggtacaatacagaggttaagatcattggcaagagattgcaacatacaggctaaaatgtctgtgtgcaagacaatcagtaaaacttcatgattctagaacaaatcagcagtgtctttgtgtcagttgtttacatgttaatcgatatgtcaatcatgtgaggaactgacaataaaatttgcggattccttattcaaggacaaaaggttaaccatgaatcataagaccatcgccacgtgggtaatttggaagcttgccaaatgtgacctaaggttatcaattaaatacattgaaggaatagttaatattcttccaaaaaggaaacttcaggaacagagggttttacttggaattctgtcggtatttaaggaataaataggggccaggtatgatggctcatgcctataatcctgactctttgggaggctgaggtgggaggatcacttgaggccaagagttcaaaaccagcctgggcaacagagcaagacgtcgtttctatgaaaaatttttaagttaactggacgtggtgatatgcacccgcaatcctagctacttaggatcccttgagcccaggaggatctcttgagcccaggagttcaaggctgcagtgagctatgattgcaccactgcactccagcagtgttctgggtaacagagcaagaccctgtcttggaaaaaaaaaaagtaataaaatgttattcaacatattctaaaaagcagagaagatagaacacttctcaactcaattaatgaggccatcactaatgtaataccagaaacaggcaaaagattaaaagagaactaaaaaccaatatccctcatgaacaaacacacacatattctcaataaaatactagcaaatacaatccagcaatatataaaaagagtaacacatcacaaccaagtcaagtttgttccaagcatgcaaggcttgttcagtatttggaaatcaatcagtgtgattcacattagtagagcaaacaagaaaactatatgattattgcaatagacacaaaaattgaatttgaaaataaattataatatccactcgtgatagacaattctcagtatggtaggaataaagtggaacttatttaacttgatgaagggtttctataaacaagttacagctaacataattcttaatgatgaaaactgagtggttaatccaaaagatccactcctgtttagcatcatactagaagtcctagttacgaaaattatttattaatagtattttatttatttataaatagtattttatttacttattaccacaggttggtagagaagtcaggaaaagaaataaaggcctcaaaatttgaacataagaaaactgcctctatctgcagacaaaatgactttctacatggcaaaacccgagaaatccacaaaacatgttctagaactaattagtgagtttagcaaggtcacaagattcaaggtcaaaacacaaaaattaattgtttttctgtgttctagcagtgcatatggtaattcaaagtttaaaaattaccattcaaaatagcataaaaatgaaacactttggactaaatctaaaaaatatttacaggatctgtatgctgaaatgtataaaactgattaaagaaatttttaaaaaagctaaatcattgggggaatatactgttttctttgtttgggagatctaatattggtaagatgtcaattatccccaacgttatatgtttctttaatgtaatctgaatcaaaatctcaaagtgatttttacagatactgacaagttcattataaaatgtgcaaggccaaggaactaaaataactacccacaaaattggaaaggaaataacataatggggatactcatacttgatttcaagatgtattttataaccacagcaatcaacatggtgtggtattgccaaagggtagtgatatggtttggctgtgtccacacccaaatctcatcttgaattgtagttcccgtaatccccaagtgtggtgggagggacctcgtgggaggtaattgaatcatgggggcggtcacttccatgctgttcccgtgatagtgaatgagtcctcctgaggcgtgatggttttatatggggcttttccccctttgcttggcacgtttccttgctgccgtcacatgaagaaggacgtgtttgcttccccttccaccgtgattgtaagtttcctgaggcctccccagccatgctgaactgggagtcaattaaacctctattctttataaattacccagtcctgggtatgtctttgttagcagcatgagaacagactaacacagatagatacacagttcaattaaacagattagagtccagaaatagactcacataaatataaccaactgacttgttgcaaagatgcaaagtaattttacagaggaaaggcagtctttccaacaaatggtgctgggaagacgggacatgcatatgaaaaataaatgcccacccatagaaatactaattaaaaattatagactcacatgtaaatttaatctatgaaaatttctttaaaaaattgggaaaatatttgtgtgacattgagacttagatacaacatcaaaagcaatattcgtaaaaggaaagaatcagtaaaatggactttgttataattttaaaactgttgaaagaatacaaagacagccataggctggtaaagagtatttgcaaattacatttctgacaaaggacttgtatctagacatgtaatgagctcttaaatcctaacagtaagaaaatgaccaacccagtcaacaatgaggaaacagatctaaacagaaacttaactacagatgtgtggatgcaaaacaaacacatgcaaagattctcaatatcattagtcattatggaaatgcaaaaactccaaccacaatgaaataccactctatgagtattattagaatagctaaagaacaacaaagcaacaagctgaccacacaaagttcaagcaaggtcacagagcaactggatttctttacttgtggtaatgcaaaatgtttcatctcccatgggaaagtgagaactttctgataatgttaaacatgtatctcccacatggtccaggcatctcgtccctgggtatttactcaagagaaatgaaaaggtgtgctcacataaaaacctgtacaggaacatttatagcaggttcatttgtaagcatcaaaagctggaaactacttaggtaactttcaactggtaaattgataaataagtgtggtatatccgtacaattgagtactactcactgataaaaagaaaggaagtattgatctatgcaacaatgtgaataaatcttaaatgcattttgctacgtcaaagaagccaaaactcaagggactaataccaaataatgccacttataagacattctgtaacaggcatacttacagaggtacagatcaagttagtagctgccagaggttagaattaggtgggaggggctgattgcaaaaggataccacaaaggaatttctggggtgatgaaatcattctgtattaaaatcttggtagttaatacgtgattttatccatttgtcaaaatatacgaaattgtacaacatgagggtgagttttaatctatgtaacttaaagtgcagacacaagatatttggggaactcaaatggaatacgaattgtaacaaatgaaactaactctattatagatgagtatcacaaccacacaacatgtgggacaggaacaaaccagttactttaaaagcattactttgacttgatactataagcccaaaggcaaaaagaatagagcaaaatgttaaactctagtaaatttatttctaataaggttatatgttagcaattctgaagctactttatatgtatatatttagggttgaatacattagtaaatgcattgtagataatgagaactgagtttttcattgtgtaagagaaagaatctacatataaagagggaaggctagaataaaccctggggtgttggagggagcttggtggtatccgtgtgaactcatgttttaaaaagcatgtgggcattacaaatatatacatatatatgcagagatgggtacaaaaataaatataaatgtgtgtgtatagttgttatgcatacacatatttttgagttctgtccctggagagggcttagaaacaatgacaccccacaacaatgaatgtacctcttactcagatcttgtattttggggggaatgggttcaggtttatttaggtataatttgtatagagtaaaatatacccattttagtgtacagttttatgatactcaaccatgtctacaattccgtcagcaccatgataatcaagagaaagaatagtttcaccacctcaaaatatacccttgtgctcttttgttaccaatcccctcccctcacttccaaaactaagtgaggccagtatgggggcaattggaagcctcatacagggctggtggaaatgtgaaacggagcagctactttggaaaacagtttgtcagtttcttgtaaagttagacattcctttaccatagacccagtaattctattcctgagtatttactcaagagaactacagactgtgcacacaccaggcctgtatgcaactgtttacagcaactttattcatagtcattccaaatgaaacaactgaagtcttcacctacaggtgagcggatgaacaaattgttactttcatgcagtggaacactactcagctacaaaaagaaatgaatttctgatgcatgaagcaaaatggatgaatctcggaaaaaataggctaagtgaaaaaagccacaatcaaaaagctatgaactctattatttcatttatataatgttctggaaagaacaaaagtacagagacaaagatcagatcttacattttaaatatcattttccaatagaaggaactagggtaccttggggaagtggtggagttcagaactggggcagagaaaattcaagataagcatgaagtatcttgtggtgtcagataatcagtaagaaaaggcaaaacagaaacaaaccaaaaaattagaacactcaattatatttgttgcaagcaggatccacccttaatgctaaaattggtgagcaaaagttcaaggagaaataagagatttgcatattctaaaagatctcccccaggttatttattaattacttaaggaaagataataactttccagtggagaaacctggcagatagcaccttaaccaagggatcaaggtaaaactcgtcagtactaagatacatccacatcttatacctcctgatacaatgcacatggattctatgttattctggccaaaaccacataaataaatctggtcaggagataacatcagacaaccccaaactaagggacgttcggcaaaataactgaccaggactcttcaaaagtatctaggtcatggaagactgaggaactatcagagatcagaggagatgaagaagacgtgattactaaatgtaatgtaggccctgggggttggattccagaacagaaaaagaacattagtgaaacagctgggaaaatccaaataaattctttagttagtactgttggagcaacattaatttcttggctttgataactgctgtgattgtacaagatgtcaatggtagagaagatacatgaaggatatgtacgaattatctcctatatttgtaacatttttacaaatataattaatttgtttaccccaatgccagttggggtaatgtctaaagttatttcaaagagttaaaaaacacaggtgcttggaggagtacagagaagagtatatataagaagacaagcataaaattggttataatttaaagaaatagcaagcaaaagaaggtgtgtttatggaaacaatgaatgttcagagaagtaagctgagaatcaaaaaaagagaacagtgtcttgcaaaccaagaaagcagcattgctcatattgtgttcctgtagagtattctcatgatataactccttcaaatagagaaatgattccatggttattcaatcttcttgaaatcagcaatacataaagtacaatgcctgtaaatagtttgagaaaggcttctctactgaccttttttttaaaaacaaatcgaatggttcccagaattatttagctatgagtcctttcttttgtttttaaatagcctcttgatatcaactttatgaaagcagcataaagttggtgccaggtacacaaacacaattcacagcacatacttggcatttatttattaaacaagtatttattgtacacctattaacatccttggactttgggatctgaagaacgtacttgggcaaagctctaacacacacagtgatgggataagtattgtgattggcgagaggattggccctggggaaaataggagtaaataaccctgagcatatgggggttgaaaaatgaggagtaatttcactgtgggctgctggtaagaagaatggagagaggatctggattgggagttagtccagaaggaaatgttacagtggccagaacgtgttttttatcctgattaattctaccttctggtcctccaagttcccatttggattataacacaaacatgtgggccttcaataagaatgttttctcatgggatggatcacaacctggtgtctccttgtaactttctgtttggagaaaatcaataaatatcatttcaaactgctaaagaatgaattttttaaaaaaatggatgtgtttgtcatgataaatttccctgacatatttattataactacttcttgaaacatttgtcagggaggcattgatgaggactggaccgttttagtcacttaggtgtattctctaaattgttttagaagagagagtttttaatgcagattaatgaattatctatgcacgtcacgataatgaagcataaagatgacttctgggcccctttctcaccttgcctgtgcaggctgagctcttccaccagctctggactgacttcctattgccttcgtttcacagtttcagtcggagatgagaaatagccctgaaatttgcttcaattcttcactaatccgagatcaaaattccccaggactgcaagggaagttgttacgcagagcagttgcagcattgggcagtaatatgtgattagcaatagaagatattcttgtgagagctgcactaacttgctttttatctgactgggccccgtaaggaacagctggttgtggttcttctgtaggaacaggcacactacttacactctgttctcttctttccagatcggtccatgtgagagatgtcaggcataggagaatagttttccctgtgaaagcttttctgctcatcttaggagagagggaaggtagattggctcccccttattctgctgtcctcataggagtcaccctttatattgatgagatgcatggtgattggtgatgagaaacaatttgagggtaccgtgaaagattgatagcagggttagattaaccactcctatgaacttgcctcagaatcacagtgtatcattcctttatatagaaaaagatgacacttgatgaaaataagcaaattcagtcatcttaaagatatttgaatgttagcttaatttatgagatgttgttactgttttaaatcaagtcataaagcagtgattattaactattttaaatttataaacttctatcataatctgataaaagttttggccctttcccccagagaatacacacacacacacacacacacacacacacacgcctgacatttaatattgactattcaatctacaaggaacaatcaggatcactgtggtagacaccatggttttctcttcaacgtctgtgcactcatttatgggcatcatgctgtttgggagggtttaaccccagccccatcttttggggagaccatgattcctctcagtcgataatatcctaatcacaccaaagggatcaggtctagttaagccaatcagtccttgacaatcccaatgttatggtttaggcatagcccaaagatcttagatgacaggacttttcctctcatccttctgctctctctccttctgtatattgtggtgggcaggtgggaagcctagaataacagaatccatttagttcccatgaaggaagcgaaccgtggcactgtgaagacaaagctgtcaactagaggcaggcagaaccaagagcatcacagagaaagagagcagcggccttgaacaaaacatgaaggaatgcactggtggggtgagacttaagcagttatgtgagctcaaacccccttagcgtgtgggccctttctgtgtaggttgtgttttctattcttttcaacaaaatagttctaaatgatagtttttcagtgctggcttttcaagtacagatgtgctggagaaggagtgaggaaagaagggtaagaaaaaaagtgttaatatctctctagcatgctgtcctgcctgtataaaaatggagctgtttatgtgtaccattagtggtgtgagtgttttctcaagaatggagatagattcacctcttgccctgtgcatctctccgctctgtgttgttactagtcttactctatggttacccaggttccagtcaaggtccatagacatggaacagaggaaaaccaactggacaagagagctgagaccactgcagcctgggatttttaacgccatgtgcgatacttgtatagaccaccactctgctgcctggctctgaggtagttgctgaaatgcggaatgtggcctgcaggtgatgtgctgagagttaagggatggtttatctttactttgtgaaattaaacttcgctgaacaaggagaagcagggaaactgacgagacctttacaaagccagtgtaaagtgtagtatgcagagcatattagacatgtccacagacacaaagcaagaaatagtgtgtattagtctgttctcacgctgctatgaagaaatacccgaaactgagcaatttataaagaaaagaagtttaattgactcacagttccacatggctggggaggtcccaggaaacttacaatcatggcggaagacacctcttccctgggcagcaggagacagaatgagagcaagtaggggaaatgtcagacacttacaaacatcagatctcatgagcctcactcattatcacaagaacagcctggggggaaccacacccataattcaattacctccacctggtctcacccttgacacaattatggggattacaactcaacgtgagatttgggtggggacagagccaaagcatatcacagtgtaaatgtacattcaggtgtttctgactgataagctttttcttttctttgggcatgtcataaaatctatattagatgtaaagatatggaagttgaaaaatgtttgtcaccttttactacccaaacccttttaaaatgacaataaaaacttacatgtgctgatgatcagagagtaattcatacagttattttgaaaactgtcactattgactaaaactgagtatgtccataccctaccttccagtaatttcactgccaactgcacacataagcaccaagagaagtggatagaatattcacagcaacattgttataggagccccaagttggaaacaatgttgatgttaatcgaagtagactggacaaatgtactgtagtatttttcatacattagaatactgcatagctacatgtggcaacatggaggaatctcatagtcatatttacaaagggaaagaatccataatgtgtgtgttagcccctaatgctatacctggaacacagtagttaccctatacatgttggtttgccatttagcttggaatttaaaacaatataagataatacaattagtgctcagtaagtaaattaaatggagttttccatttcttgttgtacatctaatgtggcatttaaaattaaagttcatcaacaaacataataaatgtgcaagcagcattttgcaaagaacattgccctcatgtaatctatcctgttctgcaaaccctaattcgtcaatctgaaaacagaaatatgtatttgctgtgcttagcataaatttaattgtagaagatggagttcttgaattcggaatcacatgatagttaaaatgataaagaatattattttttaacttttagtttattcagccttgtccattaacatttagttagcattatgcctagaataatttatatcattgcaaagaattaaattgtttgaaaggtagacatttgatagtcctgaatgttttagttcttcttgttttagaagaataagttttggatgacatagtgtgatcaaatggcttaatttcaggtgaagatatgccttatgactttcattttaaatcttaaacacctgcagagttaaattgcagtgaagctcataaaaatcgccatctgtaattgatggaacattggatttttaatgatatgctgtaggagtctgaaaagatctagtggtccattattaatagacctcccaaaaaaagactggtgggttttcttcttcataaagctgaattttatgggcaacagacaggtagggaatggtataaagtggatacaaattttttcttatttgtaatatttgaataacacaatttaaagtaagctgttacaatatcagaccaaaattgaagactgaataagcatccttaattattgcaaaataacctcttttgtagcatttagctaattcccaattaaccaggttgctggggcgagaatgcagttataactacattcagtttacaggtaatgcataaatgcagctaacaaatccacagtaatcaatagtagattatagggttttcttgtcatccctgttgttactgtttttctgtttgtttgtttttgatctgttggtgatgcttggttgggaactggaatgaacttagatcctcaggagggacacttagtaacgaggaaagagctggttatcatggactgccacaaacccccgtgtctcactacttctgtttctgcacgttctgctctgctcccttttggtgtccattctagtgtaaccagcatgttattttgtctatcgctagactgtaagctccatgagggcagggctgtttgtgttgttcactgatacatcacaattgtccagaacagggtctggcacaaggggatccaatacacatttgttgactgaatcaattatacacaattttagtattttataggggtaatctcatcccctagctcttaccttttctatttgttgatctttttcaagcattttctaggtctactccatttttcatttttccgaatttactatgctatattttttaaaatttgtaaaatatttcctctttaattttatgatggtagtgccccacaaatcaattttgagttccctcattgggaaatgggtactatatatatacttttttttctgagacagtgtcttgctctgttgcccaggctgggctggagtgcagtgatgccacctaaggtcactgtacctttgaatcctggtctcaaccaattgtaatccttccacttcagcctccctagtacctgggactactggtgtgtgtgctaccaagcctagctaagttttccttttttcgtttttagagatgggctcctgctatgttgcccagcctgtctttttatttttaaaactgttttttttttttctatcttcagtcgaatagtagaacctgaatattttcttctaatggaaataaataacaaatgtataggagccaagtgtttaaatatttgttatttcaaatgtaatagtttatctactgcttatgtttgctaagaccgacatattttatctgctggatacatttgctaggacagcattgtcttttgtgcatttattttataattggccatgtactgagctgacttagaccatgactaataggttttcagatggttcttttgagagttcttgctagtcatttacatcatttttatttctcttttacaatatttatatttcaatctgcttatatattaacccttctgttggtggttttaatgacatctgacatctgactagaaatactagttaaaacattaatgtaagtaaatgagggattgcatatcaaatatgaccacgtggaagcatgcaaataacataaattcacaaaacaatacttcaggtgacaagaacactataaaaatgttcacatccctagtaattaaaataatatacattaaaatggtatactactggccgggcacagtggctcacgcctgtaatcccagcactttgggaggccgaggcgggcggatcacgaggtcaggagatcgagaccatcctggctaacacgtgaaaccccgtctctactgaaaatacaaaaaaattagccgggcgtggtggcgcgcacctgtagtcccagctactcgggaggctgaggcaggagaatggcgtgaacccgggaggcggagcttgcagtgagccgagaccgcgccactgcactccagcctgggcgacagagcgagactccgtctcagaaaaaaaaaaaaaaaaaaaaaagatatactactattttggcccatcagcttgggcaaatcattctttttatatgtatactaatattctggtcagcataagaaacaaagtctcactactggtcagggaagtaaaaaaatggcaaacattctagaaatgaatttagcactttatgtaaaaaaacataggaaggggaagatttccttttttttgtttttgtttttgttttttaatatggactctcgctctgtcgcccgggctggagtgcagtggtgcgatctcagttcactgcaagctccgcttcccgggttcacgccattctcctgcctcagcctcccaagtagctgggactacaggtgcccacgaccacgcccggctaatttttgtatttttagtagagatggggtttcaccgtgttagccaggatgatcttgatctcctaacctcgtgatccacccgcctcggcctcccaaagtgctgggattacaggcatgagccactgcgcccggccacggaagatttccattttaagaaatgtgtcttgaaaaaagtaatttggtaaatattaaaatgcttgtaaacagatatttatcataataagaaaaaaaggcagcagtataatatctaaaccctaacagtcgttctccagagatgctgttctttgtacctgcaatgtggttaagaaaagcattttatttttctttaataattatacattaacatgtaaaaatcccatcagagtcccagcacagtggcttatgcctagctctaatcccagcactttggtaggccaagcagggaggatttcttgaggccaggaattgaagaccagtctgggcaacatagcgagatccctgcctctacaaaaataaaaaataaaattgtagccatgtgtggtggtacgcccctctagtctagctacttgggaggctaaggtgggagaattgattgagtccaggaggttaaggctgtagtgagtcatgacttcagtctcggtgagaacttgtctctaaaacaataaaaataaaataagaaaaaaagaaaagctggtttactgtggtttatgtaggcattgattttaatagtgatttacaatttcttttttttttttttcctgttgtgtctatctttctggaaggatcttaactgaaagggtatttcttacgggaacctctagtggacaccttagaaggtagagcagttgaaggagaaatatattattcacacattaatggttcgggactggtcctcatcagactggctagactcaaggcaataaatcatctctaccttcatcagattttcttttataaaaggaaagagaaattctaagttcttcaagacatggagaatattttcataatattctaggttattttgtagacattaaatctgaaaacctcaatatagtcaatgactgtattaaagcttgtagactggtttgggaaaaaaagatttctttctacattttgggacacatccagccatgtgccagaaaagtccccagaagaatttgtttgaatctggaggcacagatccactggccttctgtagcatttggtaaactgtagtctgctgctgccaactgaatgacctgttcaaaattaagtcgtctgtagactttctgaacagttactcatacgtgcaaaagtttcactgaagaaagagttagataaaaagaattcgattagctcagtggctcaaaaacttatcagtttcattgcccactttatgcaatgccacaattcattggttgacattttaacataaaattatacaatcgatggcatctcacagtccacattggctggtgtgacacagttgtcattgactgtacatgtttgtacctagtcaaaggagttcatactgccataactttaagggcagtagattgtggtaactacatgtgtatgggtctcaactcatattaaaaatgtgttcctggcagagtgcagtggctcacgcctgtaatctcagtattttgggaggccaaggcggatggatcacctgaggtcaggagttcgagaccagcctgaccaatatggtgaaaccctgtctctactaaaaatacaaaacattagccaggcatggtggtagatgcctgtaattccagctagtcgggaggctgaggcaggagaattgcttgaacccaggaggcagaggttggagtgagatgagatcgtgcctctgtactccagcctgggcaacatgagcgaaagtctgtctcaaaaaaaaaaaaaaaagtattcctgtttgttacctgaaaatcttccatggacacctccagtaagaccaagaaactgccaaaattattgctggctcttggaagaaaatcgaggtgtcagtagtggagcagcctttcagaaatgctgtatcactaatgctcttgctggcttggaagatgatgttgtgtccaaaatttcaagtggtgataaggcattgtgtcctaatttaattgcagtgtgtttttgtaaatgttataacataaaatttgttgtgtctcataatcaatgttatcttagatccaatccaagaagaaacataatttgtaatgtcccctttattatccttaaataaaattgatggataataaagctacctacatatataattttcaagaatcaatgtaattgtctatctacaatatgacagatacataaaaatatatcagtatttattcattatgaaaatgactttgcacaaccatacctgaatacctaatgaggtagtcagatgtttttatctacctatggcaaataacactggatttatgagaaataagacaatcagaagctattcttaagcaagaagcacttgcatataaaatgtacaggcacagctggatgctagactacaaagtaatggtataatgaataataagtgagaagcttttgtattgatgagagaaagaagaaaatcaccttaattaacagagatatcacaccttagaaaattataaagttttgaagtagaaataatgaggaagtgttttcatactggaactgggacttttaccactgtattgtcaacataattgcctttgttatgacatggaatgaggtagtggcaactatcattaaggatgtttacttttaaaaggacgggtgtacattcatttctctataacttagggaagatcttagagacaatatataatcttcttcaaaggtcagctggatctatggtaaaatacaggagtatctagagaatttgggttgacctctagggatattatctgagtcggatggaaaaaattagttaactacaaaatgaataaataatttaagtaactaatttttatgaactaaaaataagttaactacaaaatgaataatttcagtaactaacttttataaatttcagtaactattttttataaaataaatgaggtaataaaaactatgactgaaaatatgtttgctcttaaaagtccgggtgtgctttcagttctctacaactttaaaagatcttggagacaatatataatcttcaaaggtcaactgaagctatgttaaaatataggagcatctagagaatttgtgttgacctctagggatattatccaagtaggatgggaaaaataactactaaatgaacaaataatttcagtaactaatttttataaaataaatttctgtcattgtgctatataattattaaaaagtataaactggcaattatatgacatgtttttaaaagcatctttattattgaattcaataagatccccgagtttcctgtggctccattagtttaattgtatttggctttaagtctcctaagagaagacttcataaggtttgctgaaaacttcagtaaacattaggttagcaaatattgaatgcctaaagcttgctctttctgttgtaaaatgtttccgttgatactgacattagtccttcctcataatcgtgatttgatgatatacatgaaacagccggagaggtattcagaagaatgtaaagtatgtgaacaaaagaatattgaaaacatgatctgtcgtgtccatttttgtaaaagacagaagagtgacttatttctcctcatagtgttataaagctcagctgtaatcacttaattagaggaaggctttttgaaggaagatggagaaggaaatggcggaagagtattttggaatctcaaagagctttcctaacaaaggtgtctggtgaacaaatccttgagttcatttctacggagcaactagtcattttggaagacccgaggagataaagaaaggcctcaagaaattgaaaaagagaaatcatgtggtttgacttttcatgatatagtggaatgcagttctgttcattattatagacaatcttttattcatctttgtgccaagttaatttgttataaaaggctcagaaatattttgggaaattatatgtgttttgttgccgtgtatttttgttggggtttcattgatactcttaacgtagtatactaattagaagttagaaaagactgactacgtctatatcatgttattagtgttccacctgagagcgttccatgcaatgtcactgacactttgttttatggcaaagggacttaatcttatcgatagatttttgcagtgcagtgcacaaatccatacctattcacatctccaggaagctctgagtttgaaaactgattttcttttctttcccttcctgccttccttccttccttcctttcttttttttttttttcagatggagtctcattgtttcccaggctggagtgcaatggcaggatcttggctcactgcaacctctgcctcccaggtggttcaagctattctcctgcctcagcctcccgtatagctaggattacaggtgcccaccaccacatccagctaattttgtattttagtagagacccggtttcaccatgttggtcagactggtctcgaactcctgacctcaggtgatcaacccgccttggcatcccaaggtgctgggattacaggcatgagccactgcgtccagctaaaaactcattttcaatgctatatataataatttggttcttataagagcagacagaagcctacttagtcctataatataactgaaattaagacagaggtcatgaagaagctgtgaatacaaatgagagggagacaaggctatttctgtgtagacattatttgtaccaagtgattttaaggtggggaccatgtgtatctccagtctgaatggcagactgaggatctgtttaccaggaaaattctgggtttgcccatgtgctctccacaaacagtgctgttcaaggagtctttccccagagagaaatctattatcttgtcttttgtgataaggatttccctaatatttttattgtacacacagacacatgcacatactactcttatttataaactttaaattgctagaatcatactttattctttcattatttgcttctttcacactacagtaactttgtgagatgttcctatgttgatgttcactgttgttccacatcctcttcatttccatttccatatgaattttagaatcacctcatcaatttctacaaaaatatcttctaggacttagatgggaattaggttgaatctactgatcaatttggagagaatcaacatcttaacaataataagtattctgacccaataacattatttagttgtttagtttcagcaatagtttgactggaagactttgtgtagaattggtaatatttatttcttaagtgcttagggaaattcaccattgaagccatttgggcctgtagttttctttgtgaaaaggcttttttagcaacaaattcaatttctctaatagatgtaaggctactcaaatatacatttcttattgagtgaattttgtcagtgtttgtctttcaacaaatttgtccactttgttgaaattgttgaattttgtcacagacttgttcttaaagttgttctttttttttttcagagcaggattggaagtttattttaaaaggctttagaacaggacaaaaagaaaagcactgatattgtctggctgtgtccccacccaaatctcaacttgaattgtatctcccagaagtcccatgtgttgtgggagggacccagggggaggtaactgaatcatgggggccagtctttcccatgctattctcatgataatgaataagtctcacaagatctgatgggtttatcaggggtttctgcttttgcttcttcctcattttctcttgccaccgccatgtaagaagtgactttcacctcccaccatgattctgaggcctcccgccagccatgtgaaacaataagtccagttaaacttctttttcttcctagtcttgggtgtgtctttatcagcagcatgaaaacaaactaatgcggtaaattgataccagtacattggggcattgctgaaaagatacctgaaaatgtggaagtgacattggaactgggtaagaggcagaggttggaacagtttggagggctcagaagaagacaggaaaatgtgggaaagtttgcagcttcctagagacttgctgaatggctttgaccaaaagcctgatagcaatatggacaataaggttctagctgaggtggtctcagatggtgatgaggaacttgttgggaactggagcaaaggtgactcttgttgtgttttagcaaagagactggtggcattttgcccctgccctagggatttgtgaaactttgaacttgagagagatgatttagggtatctggcagaagaaatttctaagcagcaaaacattcaagaggtaacttgggtgctgttaaagacattcagttttataagggaagcagagcataaaagttcagaaaatttgcagcccgacaatgtgatagaaaagaaacacctattttctgcaagctggctgcagaaatgtgcataagtaatgaggaaccaaatgttaatccccaggacaatggggaaaatgtctccaggccacatcagaggtcttcatggtagcccctctcatcacaggtccagaggcctagaagaaaatggtttcctgggccacttcctcccatcacaggcccagagacctagaagaaaagggtccctgtactgtgtgcagcctagggacttggtgccctgtgtcccagttactccagccatggctgaaaggggccaatgtagaactcgggccgtagcctcagaaggtgtaagccccaagccttggcagcttccacttggtgttgagccggcaggtgcacaatagtcaagaacttgggtttgggaacctccacctagatttcagaacatgtatggaaatgcctggatgcccagacagaagtttgctgcaggagcagggcactcatgtagaacctctgctagggcagtgcagacggaaatgtgggatcggagcccccacacagagtccctactagggcacctcccagtggagctgtgagaagagggccactgtcctccagaccctagaatggtagatccaccaacagcttgcaccgttcacctggaaaagctgcagacactcagtgccagcctgtgaaagcagctgggatggaggctgtaccctgcaaagcgacaggagtggagctgcccaagaccatgggaacccacctcttgcatcagcgtgacctggatgtgagacagggagtcaaaggagatcattttggagccctaaaatttgactgccctgctggatttcagacttgcatgggccttgtaaccactttctttcagccaatttctcccatttggaacagctatatttacccaatactgatacctccattgtatctaggaagttaactagcttacttttgattttataggcttacaggcggtagggacttgtcttgtctcagatgagactttggactgtggacttttgggttaatactgaaatgaattaagactttgggggactgttgggaaggcatgattggttttgatatgtgaggacatgagatttgaaagggccagggatggaatgatatggttcggctctgtccccacccaaatctcaacttgaattgtatctctcagaatttccatatgttgtaggagggacccaggaggaggtaattaaatcatggggactggtgtttcccatgctattctcataatagtgaataagtcttgtgagatctgatgggtttatcaggggtttccacgtttgctttttcctcattttctctcgccgccatcatgtaagaagtgcctttcacctcctgccatgattctgaggcctccccagctatgtggaactataagtccaattaaacctccttttcttcctagtcttgggtatgtctttatcagcagcgtgaaaatggactaatacaagtacatttggaagagactcaagcaggcacatgaaggtcaggtgcccttaaaattttcttaatattctcttattacccttttaatatttatagaatctggccggtgcagtggcttacgcctgtaatcctagcactttggcaggccgaggtgggtggatcacgaggtcaggagatcgagaccatcctggccaacatggtgcaaccccgtctctactaaaatacgaaaaattagccaggtgtggtggcacatgactttagtcccatctactcaggaggctgaggcaggggaactgcttgaatccaggaggtggaggttgcagtgagctaggattgcgccactgcactgcagcctggcaacagagtgagactatctcaaaataaagaaagaaagaatagaatctatagtgatgccacctcttttatttttaatatttgtaagctgtgtcttacctattttctctgcttagtttggttagaactttattaattttatggatcttctcaaagaactagcttttggttttatttattttctccattattttcctaatttctagtttattaatttccaccctgaacttttatttcctttcttctacttcctttgatgttaatttgcttttctttttctaagtttcttaagatggaaaccaagatgttgatttgaaacctgtgctctattctaacgtagacatttaataaatttccttctaaaaattgctttaaaagactccctcaaaattaatgtggtatgattttattctcattcccttgaaaattctttataatttttaaatttcttctttgattgcattttttgtttcttctttgaaatatagattatttaaaggggtataatttggtttccaaatatttggatatattccagcgatcttgctgttataaatgtttaatttattttcattacagtcatatcacatacatcccatgactttaacccttttaaatttattgagacttgtttcatggcccagaattgggtctactgtggcgagtgatccatgcacacctgagaaggatgtgtgctctcctgctgttggctggagttctctgtgataaaaagtcggtcaggtttgttgatcctattgttctagtgttctacatccctgtttacttattctatccattattgagagagaggtatgacagtctatagctataatgatagatttttccatttctctttgcagatctatcggtttttgtttcatgtagtttgaagctctgctattaagtgcataaacatttagggttattatattctcttgagggattgacacctatatcattgtgaaatgatccctgtatccctggtaatagtatatgctctgaaatctactttatctgatattaacgtgctcctctggctcttttatgacccatattaatgtgatgtttggtgaatgatttgatttgcccaaattgaagcctggtgtttgtctccagctcctggaagtgaacctttaaacccttgaaatgtcttgagtgataggagtgtttttgttatttacggtgggtccctgggactatgcctagtattttatgctacaaatataatttgtgctaaaaatataacacgtggcacaaaggccacatgttaccaacctgatctctgggggtgggtggcctagagactgagttcaatgggccagcaatgaaacaatcaatcatacctacataatgcagccacagtaaaatctctggtcagcttcctaagttggcagtactccgtgtatatcatcacatgtggattccaggagggtaaaatacccaggagccctgtgtgtttcctcaacttgagtgtggactgggtttagtgacttgcttctagcagagagaacgtggcagagttgaagagatgccaccttcaaaactgggttacaagaagactatggcttgttttgcctctttctttttctcactcattctaagggaagccggctgccatgttgcaagctgccctgtggaggggcccacatgacaaggaacaatgtgtatgacaccaactgccaagggcctgggatctgccgtcagtcacatgagggaacttgaaagtggatcattcccatttagctctgagatgactgcatctctggctgacactttcatcacaggctttcaagagactctgagccacaggataaaactaaaccacacctcgattcttggcccacaaaaactatgggatgtgttaagctactgaatttgggggtaatttgttatacaataagaactatctaacaaccagatgtaaaaaatgaaggaagaagaggagaagaagaaaacggggaaagtaaagaggggaggaggaaaggagaaaaggatggagagtgtggagaaggaggaggaataggatattatattaattaagccttaagctcaatgatgcaaaagttctgactcagactggactaaaacaagaaagttcataatatactgtaggaggaagtcaaaaacaggaagaataataagctcatatgattcaatgactcagttgtgtctttctatttcaatattggcttcatcctcagccttctagcaagctgactcagcctgaatttccagtgtgttagcttgggttgctgtaaccaactaccacagactggtggcttcaacagcagtcatttttttcccacagttctggaagctggaaaacccaagatcaaggtgccagcagatatgcttcttggtgaattctttcttcctggcttataggcggccacctcatgtgtatcctcataaggtagagagagggagctctggtgtccctccatcttcttcttcttttttttcttccttttgaaatggagtctcgctctgtcgcccaagctggagtgcggtggcgagatcttggctcactataagctccgccttctgggttcacgccattctcctgcctcaggctcccaagtagctgtaactacaggtgcccgtcaccatgcccagctaatttttttgtatttttggtagagacggggtttcaccatgttagccaggatggtcttgatctcctgacctcctgatccgcccgcctcggcctcccaaagtgctgggattacaggcgtgagccaccgtgcccagccccctccatcttcttagaagggcgctaatcccatcatgggagcctcaccttcatgacctcgtctatacctaattacttcccaaaggccccacttcccaatgcattgaaggttagggattcaatatacaaattttaggcaggtttcggggatgcagaaattcagcccatagcatccaacagctagacaaagaagagatattggttctttggttttccctagaagaaagaaatgtcttctaccatcccccagctgattttatttcttgtcccactgcccagtcctcaggcacatgccagcggcaatcacaggcaaaggctctgagattcattcaacctacttggggctggagatggggccccttccactgaggcccttggctacgaggggatgtggaggacccctaagtaaaattgtgttccttaaggcagcagtccccaacatttttggcaccagggactggtttcattgaagataattgttccatggaccagactggtatggagtggcaggtgatgggtttgggatgattcaagtgcattacacttactgtgcactttatctctattattattacattgtaatataaaatgaaagaattatacaactcaccataatgtagaatcagtgggagccctgagcttgttttcctgcaattagacagtcccactggggggtgatggaagacaacagatcttcaggtattagattctcataaggatcaggtattagattctcataaggagtgcacagactagatcccttacacgggtagttcacaacagagttccagctcctatgagaatctaatgccactgctgatctgacaggaggcagagctccagcagtaatgtgagcaatggggagtggctataaatacagatgaagctttgcttacttggccacccctcacctcctctaggaggtgtgcggccctagacaaggccgtggactggtactgggggtcaaggacccctgctttagggcatgaaacagactgatagctactggtagctgccaacggtatgaatgaagatgttcaattcttctacagaaaaattcttcaccttcacagttgatggaatgtagtagaaatttctgtttgactcttccatggtatctttcagactcactgatttatctaaatatatatattttttatggaactagtcagccatacccatcttcaatcttataagcaaagaaataacttctaaggaatttgtacgatgaagacatatttttgagctgagtggctcctaatcgcccatttttccttgagggagcatttattgagtgtttgttgtgtgctggcagtggattccagactgaacaaagcagacactgcccctgctcccggagagcttgcaccgcctccatgtacacaccatcccgctctactgcagctgtcctgatcacctaagaagtgatcatcagattctacattttatagcccataacatttcctcattaattcattgaagtttaaacttctcatccatgtgtgtgtagcaagcttagttctgcaaaaatgtttgaaatttgccacttcctctaaaaaagatattttcttctgtgatcattaattataataaaatgtgtttacactcttgagactgaattaactgtctcattctattatcccaatatttatgcatttgtaatttagataagaattattaatacaattttaccatgagctgtatgaaacagatcaaaagtgacagtaacaaggcatattataagaaccctaaagtattcctttttagacaaaaaatagcatatctggcagagatgcacagaaaggggaatgctagtacacttctggtgggaaggtaaattagtacagcacagccactgtggacaacagtatggagggttctcaaaaactaaaaatagatctgtcatatgatcctgtaatcccactgctgggaatatatccaaaacaaaagaaattggtatgtcaaagagatatctgcacacccattttattacagcactattctcaatagtcaagatatggcatcaacctaagtgtccatcaacaaatgaatggatagagaaataccatatatatacacacaatggaatactagttagccataaaatagaataaaatcctgtcatttccagaaacacacatggaactataggttgtcatgttagttgaaataaaccgggcacaaaaagacaaatattgtatggtctcactcatatttaagagctaaaaaagttcatttcatgaaggcaaagagtagaatattggttacagacgctgggaatggtgttgaggggacatgaagagaggttgcttaatgggtgcaaaaatacaatgagatgagggactacattctaatgttcaacagcacagtgactacagttaacgaaacttttttttaatggaatctaactctgttgtccaggctggaatgtagcggcaccatctcggctcactgcaacctccacctcccaggttcaagccactctcctgcctcagcctcccaactagctgagactacaggcatgcaccaccgtgccaggctaatttttgtatttttagtagagacggggtttcgccatgttggccaggctggtcttgaactcctgacctcaagtgatctaccctccttggcctcccaaagtgctgggattacaggcatgagccacagcacccagcccagttaacaaaactttattatatatttcaaaatagctggaagaaatgatttgaagtatccccaacacaaagaaatggtgtatgtttgaggtgatggatatgctaattaccctgatttgatcattacatgttgcatgcaagtatcaaaacatcacatgtacttcaagaatatatacaattacatatcaattttttaaattattttctattgcttagtttaagctgtttgtagagcttatgtataaactgcagcaaatgcagaaagtcaatcagtggccaatggcacagaacaggcagcacatttcggaatttcaaagccctgtgtgcgcttatctaatcaccttaatatttgggtgcatcacacaattttttagacaatgttctagtttctaattataaaaatcatgtgtgtttcagttttcacagtttcaacaccaaagaaatgtatctatcactcatgagaaggaatcaaggaagtcaattttggaaagtcaaaaatgaccatccatcctcacaacgcagggcataaattctatgtcaggtctccttgcacatgctccacgttcctcattaccctatgggttctttcaaacctcatcagtcctcgacctgtgccttaaagacagcaggtgtacagcggtagagggagagcgggaatggactctgggtcactggtcaagctgcccagctgtgcactgcacaagagggaaatcctcagagtagattgtgtggatgatggcaggaaagggggccactccagccgctctgctgggacactgttgagagccacacagacccctaagctattaagtggcaacagaggagcctcagagcctatttgtggtgggagaagaaagaaaaaagaaattgcaagatggctcaaggcaattgctaaacttttttggaggacgtggaaaaccgtggaacttctccccaagaaagtacataaacaaaaagtcctgcattaaaattcagagagcccttgaggcagctcttgttctcagactggccatggttcattaaaagttaactggactcttcttctccaatactgatttctctgtttctaaatttctcacatatctagcacatcactttgtttacagaaaataattctgctaggaagtcagggcaaatattgatctcctcatgtctcaaacagaggggaaaattcacagaagcaaactttggaaagtcaaaatgaaaagtgtaagtgacttgcctgagatcagatggttatgtggtggcaatgccgagatgttgaattgcattgagctggaactcagaaagtttcggtcaggagcaggcacaccatggtgccaaattagcttggctttcggagtggggcacacctaaatctaaatgccatttgtgcacgttgcctaagccaccagaaactttgtttccttacctctgacaagggaataacaatctgccacacagggggccccaggagggttaaatgaggtgaaaagaaataatagctcaatcccaaaaccagcgctcacctgtgcctactggtggggaattctccctataacgagtcaccttgagctttatttaaggggccttccttgttgaaatactgaaatgttactaagactttcacacagtaatatttccaaataagaattctgtctgtattccagaaatttgagagatgataaaaaagaagaaacaaacaaaatattggctgatttctgaaatgagctcatctcctggcctgaagtatgacatctgattacccctcttccagcacaagttattacactcctttactcaattattgatgttgtaaaatgcactcgaattttatctctgtgatgctgctgcctccaattcccttgcctattcgggaaatgcataaggaaataaaattataattcttacttctgaagaaaaacctgttttgaagtttgaaacttgtgtcactcattgaaaaagaagccccctattttttattctaaagaacttggaaagaagcatgtttaatgtgtcagggactcccagtggctctactttgaggacacaccgaggatctgaccacttttcatcactgtggtggtcttgtccagctgaaacaccctcgccccaatcactgcacagccttggaactggtctgcttccttcctcgaccctctgatatgctcagcccggcaggcaggcagggtggtcctagaaaaacatgcttcagattcactgctgctgtgttccacgtctgtgagagcatggtctctcatgcagagtagacctggcccaacaacagctcacaaggccctggtaaccagcgtgcccgcatctctccccttctccacactggcttggtccagacacgtgggcgtcccaatgttcttctacgatgccagcataccctagcctgggatatttatccacttgtccctggcatatgcaaacagtgacggttaacttaatgtgtcaacctgagtgggatacaggatgcccagattcaacattattttggggtgtgtgtgtgaaggcatttctagatgggattagcatttgaattcgtggactcagtaaagcagagagccttccccaatccattggggcatctttcagtccatggaggcggactcaaatagaacaaaaggcagaggaaagaattcacccctttctgcccctgcctacctgcctgaacggggatgcttcacctcatcttctctagcccttggactcggattcacgccactgtctccttggttctcaagtcttgggactcatacggaattatatcactggctttcctgcctcttcagtctgcagatggcagattctgggacttctcagcctcctaatcatgtgattattcctcataataaatctccatatatatatgtgtatatatatatgtattatatatgtaaagatatagatatctcttagatatacaatatgtaaaatctccttttatataaattatatataaacttacatatatggagatatacacaaacagataaggatatatatgtatatatagaaacagataaatgtgtatgtgtacatacacacacacacatatatatatacacacaaggatatatgtacctctcctattggttttgtttctttgaaggaccctaatacacaaactctttatccagatatctgtactccttactccccaagaatttcaagtctttgctcaaatgttaacttttcaaggaggtcctccctgtccaccctctatctgaaattgcactataatccctagtacttttttttttttttgagactgagtcttactctgttgctcaggctggagtgcagtggtgtgatctcgactcgctgcaacctccgcctccctatttcaagcaattctcctgcctcagcctcgtgagtagctggaattacaggtgtgcaccaccacacccagctaatttgtttgtatttttagtagagatgaggtttcaccatgttggccagactggtctcgaactcctgacctcgggtgatccacctgccttggcctcccaaagtgctgagattacaggcatgagccacagtgccccacccactagtacttttgatatctagcttgctctactcatggtaccgtcattcatcaattttagtgtagagataattttctatattttaatatctctagaattaggatggatctttacaaaccctatcgtcagggaaaggtgatgatattgttgccattgcttgtagatatacatcaaaacctgtagcatggatgtcagaggcttatgagaaaaatattaggatggtgcaaaagtaattgaggtttttgccatttaaaaacttacagctggacccattggctcatgcctgtaatcccagcactttgggagactgaggtgggtgaatcacaaggtcaggagttcgagaccagcctggccaacatggtgaaatcccctctttactaaaattagctgggcgtagtggtgggcacctgtaatcccagctactcgggaggctgaggcaggagaattgcttgaaccctggaggcagaggttgcagtgagccgagattgcaccattgcactccagcctgggcaacagagagagacttcatctcagaaaaaaaaaaattacctttgcaccaacctattaattaagcactgttaatgacatcaatcctgacattgtactgggaaaaaaatgatcttgactctattggtgttgaaatgtgattcagaaaagccaaccctggatgtgaagacatttcaggaatgcagaaacaagtttatttcatttgtattttcctttcagcttattaacaaaattgatatgtggcaaaaatcatcagtagacacaaagggttattttaatgaaataaggacttaagtaaaaattaatatttcaaattttaagtgccaaaatgttgtttctttttcattggtataggaagcaatggtctttattacagtcaatgacattttagacttgataaaatatagtatatgactgatgtattttgttgtttataacctgttgactttgttattgttagtccaagggccccgcagagagtaagcctcaggaaataatagcagttgttgttgttggaacactcttagaatgcatccaagtcagacgtcccaaggaaggtaatcttgggttaagttttgaaagagtggcaacgtttgtttaaaatactttcctcccaagtctttactattgtgagtagtgctgcaataaacatacatgtgcatgtgtctttatagcagcatgatttatattcctttgggtatatacccagtaatgggatggctgggtcaaatggtatttctagcccaaatgtccaacaatgatagactggattacaaaaatgtggcacacatgcaccatggaatactatgcagccataaaaatcataagttcatgtcctttgtagggacatggataaagctggaaaccatcattctcagcaaactaccgcaaggacaaaaaaccaaacactgcatgttctcactcatatgtgggaattgaacaatgagaacacttggacacaggaaggggaacatcacacactggggcctgtcgtggggtgggggactggcggagggatagcattaggagatatacctaatgtaaatgacgagttactgggtgcagcacaccaacatggcacatgtatgcatatgtaacaaacctgcatgttgtgcacatgtaccctagaacttaaagtataataaaaaaaaatacatatatatataaatactttcctccctcgtttcatctggctgagggaagatcacatatctgacgtcaggaagaatgaagtgtttggcagctcaggaccatttttcatgatcagaacattaaggtgcctttggggacagggagaaatgagccctccctgcctctggtcactcctgtccattcagccagagtcctgccctgacacctggctcactgaccaccttatctccccttttaaatcttacagagtctctgttcccagctcctccaccatgggaccctcatggaagtcccctatccagatgtaatttctctgccttctctgaattctaagcactttatactcctgtaattaatgtataaatcatacattaattcattggtttacttctttgacaaatatctgtagggtgccttctctgggtcagtccctgttcaaggcaccaggaacacaggtgaaggaggtacagtgggtgtgagactcaatttccagcttcagtctaagctcctgcaattcagggatgagatttcatatatacatttttcaatccttatataatgccttccatataattggtggcttataaaggatgatggcttatggtctttattacttacatgtctcatcattcctgtacaactgtagcaaatataaacatcaaaatgcctctagatcttcttttcctcataacatattttctcctttctgtcattttgaaagtgttgtatattgatgcccctggtcatttaggaatgcccatttctctttgttctagtgctgttgtgtgggtgaaggttgacctagtttcagagaaggggtgaggaaaggcaggggcaaaaagaataaaggaaagagtttcttttgagtacaaataaaaactaccagggaaatctgatttaccaaaatgttctagggattagatttgcaactattaaatatgatttaactgaaggacccctccggccttttttattcccttcttttttactaaaattctttatcgaattgcagaatcctttttcatttgtctcagtaagtaaacttcaataaattataggtaaaatttagaaaactgaaaattctgttagagattagaatgcattaatatttcttgccttaggctgggtgcagtggctcacacctgtaaccccagcactttgggaggctgaggcgggcacatcacctgaggtcaggagttcaagaccagcctggccaacatggtgaaaccccgtctctactaaaaatacaaaaattagccaggcatggtggcaggcccagctacttggtaggctgaggcaggagaatcgcttgaaccagggaggtggaggttgcagtgagccgagatcgtgccacagccgagatctgtgagcctgggccacagagcgagactccatctcaaacaaacaaacaaacaaacaaaaaaaaaaacaaagaccatagaagcatatgaataatatgaatagggttttggagatttcacaggacatgcagtaaatgcaaggcatcgtagaaaaataaagtgtccagggtgagtcccccaaatcagcttgcttccttggagatgtgccactctttcctgaaagtttacaacaaaggaaatgtcagttatctgaggttttggcggggctcgggtggaatgttgtgatgaattattccttaaatgccctgagactgagcatgggttccaatctggatgtttccagctcagctgcaggaggagggagaatttagacagagacgttgtccgccaaagctaaataccttccgcctttgcctacttttcatttccaaacaccagtattgattccttccacgacgaatcgatcttgtggcttgaaagaagcctctacctggaagctgtgggggagggatgaagtgcaagagaaaacatctgttaatctggacagaggcagcgtggcctgaaatgaagacataccaagcccatcctgggaagaagtgtttctccaggtggcagcctgcaggaagcagagctccttctgaacaggcttcccactggctcctttctttttgatatttttttccagctttgttaacgtatgacaaataaaaattgtgtatatttagggtgagcgatatggtgttttgataaacacattgtgaaatgatcaccacgatcaagctaagggacatacccatcctaaccttgttgccactgtgtgtgtgtgtgcctgagtgtgtgtgcctgagtgtgcgtgcctgagtgtgcgtgtgtgcacgtgcgtgcgtgtgtgcctgtgtgtgcgcacgtgtgtgcctgtgtgtgtgtctgcgcacatgtgtgcctgtgtgtgtctgtgtgcatatgtgtttgcacgtgtgtgtgtgggcatgcctgtatgtgtgcctgtgtgtgcgtgtgtgcctgtgtgtgtgcctgtatgtgtgtctgtgtgtgtgactgtgtgtgtgcgtgtgtgtgtgtatgtgtgatgagaacatttaagatctgctctcagcaaattccaagtacacaatacagtgttatatacattagatctgcagagcttattcagcttctatctgaaaggttgtaacctttgaccaagatcacccgtcctcaactactgttctactctatttctatgagtccacctttttagatttcacaagtaagtaagatcatgcagtgtttatctttctgtgcctgggttatttcacttggtataatgttcgtattcttgtaaatagcaggatttcattctttttttaaagctgaataacatttcatttgatagttactacaatttcttcatctatcaatggattcttaagttgcatctgtatcttgattattgtgaataatagtgcagtgagcatgggagtgcagttatctctttgagataatgatttcattttattttttaacgtacacccagaagtggaattgctagatcatatggcagttctattttgatttttatttttttgtggaacctccatactactttccataatgactataacaatttgcagtcccaccaacagcatgcagtttttcccttttcttcacgtccccaccaacactcattatattttgatcttttaataataaacatcctaacgggtgaagtgatgtcacattgcagttttgatttgcgtttccctgatgattagtggtgctgagcaccttaatatacacctgttgcatctccgtatgtcttctttggaagaaatgtctattcaggccctttgcctattgttttacttgggttatttgattctttactattgagttgtaggagttccttcttctctttggatattaattctctgcttttcagtgccttaaagtttctgtgtccccacccctaccacgtgttagcctttgctcagttctacatcatgtctgctcatccctgtgacccagcgctgtgcctagcatggacagatgctcaaagcgggattgatgactgaatggatagacaaatgtggcttgatgttttcccgcaagcagttcgtagtcttgtgaatgctcagtggtaacacttccgtaattcctccccattctactcttcatctatgcttcctacctagaatgtttgagttggaggagcttgcagccctttccttggtgcagtgttggtggaactcaggaaattgtagttcctaaagataatgtgatcacctaaatataatgacttgctggtagagagcatggagcagcaccagaaagcctgtgttctaaccttggatctgtttcctgctgagggtatgtatgagctccacgaagttgcccaacatctctgagcctcactttctcacatctcccagttgggtgattattcctctgcactctcttctcagggttgttacaagggtcacatgagttaattgatgtgagaactttcaaataaagtgtagaaattattcatgtgttagggatcattatttttcagcctattctctcccaaggagtatctttgtatcttagcagaagtctccagtgccttaaagaagctaccattagaaggaatccaggcagagtcctgaagaacacgttttggatcctgatgagtcttcaggtcactgttttgacaacatcatgctgcagttttaggcaaagttcaccgacttgatgccataaaagcgagtttgcatgacataagctggacaagtaccatgcttctcatctcacagctgtgaagccttgtccacgtgttttttgtatttcagagaacaactgaaatatcaccatcatttcacagcagctcatttctggtgttgacacatgactcatagggttttagagttggaaaagaactgataggtggtaagacttacgatgtatgattaaccaacccctcagtgaaccatgaagtttttaataaaacatataaaatactagacaggaataaaccttcatcctttacagtattactgatacacagtgagaaaactcaaatacctggagcgaaaggaatgggatgacattggtgtaagaggcactgggaggaaatagtcaaatatgtatgttactacattaaataggaattagaggagggaagaatcatttgcctaactagtgtttcttccaaaatcaatggaaatttaaattgaatgatatttttctcagtttttcttttcttctacttgttttctctcctaaataatccaaatcgctccctctcctctctctctcctctctctctctctctctctctctctctctctctctctctctcagtaagcaccaggatacctattctatggcacatgcttgatagttcttgctaagatactcaagtcttaagtcctaatcaactttcatttttatttcatcaagagtttaaacattaatttagtgataatgatagaatggtaggaaattggtcccatagcctcagaacaaatcacaccatataaatgtgtctatcatattcaagattactttcttttgatgaactgttctattagtgcatagtttaaacacatggccagcctatgctttaaccagtactggaatttaacacacagcggcaaacaggaatcttgcttaacttgacttggactgttgctcagcgcctgctgctgaccctctggtgagaatgcaataacccagaatgacggatgagtcagggaggctggacagcagattgtccagaacagtatgtaattcccatgagagggaaggctgtggagaccagctcacccacctcactgactccctgcaaggcccgagttaaaggatgctccacaattccctctccattccagaatgacatttcattctgatcaatgtcctcttactaggttgacttttactctctcaaatgcgctgtttaaaatacaagttgctctggaatatggcccattaaatgaattactggggcagagcatttttccctgcattagagaaccaaggcagcccaatgagaattggtgcctaggaggatgcagagtgaggaggaatgagcagagaggggagggcaggacacatcaacatccaaaatttgagtcgtccacttcatgatctcctttttggggtttgcttgtcacttcttcagggaccctctgccagtcgaaggcattgtgtccaccctctctggaaggctgcctgtgaggaatgacaggagatgagaccacagaggcacaggacactagaagtcagagaaacttttgagaccatgagtctcaattcctcattttacagacccagatattacagctctgctcttaaagtcacaaaacttatgtaaacgttgtgtgttttgctgagctagatgaagaccattttgaggccttatgcacctgctgtgtttttggtgggactctctcctgtccccaggctaagattctttacatgaattctcaaattccacagatgatgagattttatagcatcttccagtgttgggtttggtttttgttattttgaatgagcgtgctgactgtaggaaatgatgaactcaagtggcagttgagatcagagggactgaaaacaaagtcaagtgtaacaggatgctgctttggtggtgtttttaccgcccaaatgcacagcccggatccacacaccttgacttcatctctgttccccatttattttccaccggatctccgtgggcacttttttctcctctttcatcttttcctctactcagaaaagtgcttataaaagagcaacggtgatattgcttctatttgtcttcttgaaggaaactggtttaccctgaccctctctcgtgcatttccagccaggtcgattcttcttaggcctgtgtttgtctacgctcaccttttaacatttgggccaggggagggacaggatccttaaaacatgatacctatttccacatctgaggaaatgtaaataggttgttgtagattttcttaatatcatttttgtaccaattcctcacccaggcaattcactacaaccttgaaactcagcatgtttctgggtattctgtctggtatctgaagactctccgaacccagttctgcatgtggctaaattacaaactcagaggagcagcttccaaatacgagaattttctgggtggtgatttagtcaacatgtaaatgctaagctctgattggaataggaaaagccccctcaaaaatttatttttcagaatgaatgagtcaaagctctacgacttcctgtctgctggacacaaaaccagaaagcctgattcaacagagaaagtggctgaggtcaaggctgcaaggactaatttaggattgggattcttgctcttgactcaggcattgaagtagcctcacagagaaataatacattccagaaatgccttggtttctgtgatctccatctagaccaacaaatcgccctatgtaatcagcctacagtgcatctcaagaaagtacaatataaatggaaatatacaacctactgagaccaaaacaaagatttattttaaaaaaagagacgtctttacatgcatcactagattttaacggtaatgaagatgggtcattgagggtataaaacgctggaatcctgcatcagagtgcctggtgaggaaatttttttttattattattatactttaagttttagggtacatgtgcacaatgtgcaggctagttacatatgtatacatgtgccatgctggtgtgctgcacccattaactcgtcatttagcattaggtatatctcctaaagctatccctcccccttcccccatccccccaccctgcaacagtccccagagtgtgatgttccccttcctgtgtccatgcgttctcattgttcagttcccacctatgagtgagaatatgcagtgtttggttttctgttcttgcgatagtttactgagaatgatgatttccaatttcatccatgtccctacaaaggacatgaactcatcatttttatggctgcatagtattccatggtatatatgtgccacattttcttaatccagtctatcattgttggacacttgggttggttccaagtctttgctattgtgaatagtgccgcaataaacatacgtgtgcatgtgtctttatagcagcatgatttatagtcgtctgggtatatacccagtaatgggatggctgggtcaaatggtatttctagttctagatccctgaggaatcgccacactgacttccacaagggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgagttcattgtagattctggatattagccctttgtcagatgagtaggttgagaaaattttctcccattctgtaggttgcctgttcactctgatggtagtttcttttgctgtgcagaagctgtttagtttaattagatcccatttgtcaattttggcttttgttgccattgcttttggtgttttagacatgaagtccttgcccatgcctatgtcctgaatggtaatgcctagggtttcttctagggtttttatggttttaggtctaatgtttaagtctttaatccaaggaccaacaaaattgatagaccactagcaagactaataaagaagaaaagagagaagaatcaaatagatgcaataaaaaatgataaaggggatatcaccacccatcccacagaaatacaaactaccatcagagaatactacaaacacctctatgcaaataaactacaaaatctagaagaaatggataaattcctcaacacatacaccctcccaagactctaaaccaggaagaagttgactctctgaatacaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaattcattttatgaggccagcatcatcctgataccaaagccgggcagagacacaaccaaaaaggagaattttagaccaatatccttgatgaacattgatgcaaaaatcctcaataaaatactggcaaaacgaatccagcagcacatcaaaaagcttatccaccatgatcaagtcggcttcatccctgggatgcaaggctggttcaatatacgcaaatcaataaatgtaatccagcatataaacagaaccaaagacagaaaccacatgattatctcaatagatgcagaaaaggcctttgacaaaattcaacaatgcttcatgctaaaaactctcaataaattaggtattgatgggacgtatctcaaaataataagagctatctatgacaaacccacagccagtatcatactgaatggacaaaaactggaagcattccctttgaaaactggcacaagacagggatggcctctctcaccactcctattcaacatagtgttggaagttctggccagggcaattaggcaggagaaggaaataaagggtattcaattaggaaaagaggaagtcaaattgttcctgtttgcaaatgacatgatcgtatatctagaaaaccccattgtttcagcccaaaatctccttaaactgataagcaacttcagcaaagtctcaggatacaaaatcaatgtacaaaaatcacaagcattcttatacaccagtaacagacaaacatataaacgctggaatcctgcatcagagtgcctggtgaggaaattttttttttattagtatactttaagttttagggtacatgtgcacaatgtgcaggttagttacatatgtatacatgtgccatgttggtgtgctgcacccattaactcgtcatttagcattaggtatatctcctaaagctatccctcccccgtccccccaccccacagcagtccccagagtgtggcgttccccttcctgtgtccatgtgttctcattgttagcctctctgacatgaaaatcctgaagcatcccagtggtacttcaacagaagaggtgacacaaactcccaagaagttagtcctttgtcagaaaaagataaccttgtacagcttccctaaaacaaattcagacagagatctggtcatcaacactcctgtttaaacttgcaaagccatcatctctgtattgtgagttatctgtgtttcattataaccgaagttcatctgcacaaattggcattctaaattgttacttgttattctgcacattttatgatgagatagttacagaaataaattaatataaattaagagaatatcacaaattagtagaataaggaatggccaatgtttgtcaagaagctagctaaggtttccaatgtcatttattatataaattaatattctcaccacatatcataccccaatctcagatgtatttaagtagctaaatagaaaaatagaaaaaagaaaatattgtgtgttatagaaactaagaaaaatagaaaaaagataatactgtataatagaagctaagaaaatggagataaataattattatctcaacaaaaatatcatcattagaataaaagcaataaaagccaaaaaataattagaaggaaaatatttatagttttactgtataataaacatacacttaaatataaagcagaaataaaaggaaaacaagatctggtaaaatatttgcaacaaatttcctatgttaatatatatatttagtatgttaggagatcaaacaaattaaaaaatcaggcaaaatacatagtgaagatgtcctaaaaaccaaaagcaagtttgaaatcagtattaattgttgctctcctatttgtaacagtgaaaaattggaagtaactgtttcccttatgattaaatattgacaacagcatgcaaattgataatttacataatatttaagaggaaggacaaagcagatataattaaatcccctctcttcctttaaaatgattgaaataagagtaaagaaacccaaaaggaactatgtttatatgacactgaaaagcaaaggaggaagccacagaccaagattttgacaaatttctgcaagacagaaggaagacaggatcacattaataaacatatcccagtagaggaatccatggctcagagcacaggtgagacccatttactaggaatgcactcactcccctaacacccctctgcatggagcagctacacagagaaatgagatttgacactaagagggtgatttgtggaacggatgcaaggcaactcttaccaagcctctctccccgtctcccaactgtagagctgagaacatagcctcaatctcagaaggtggcatcaagaccagcgggagagaaagaactagtcaacaagcgatgctaaataattcaggatgcatggcttacccatatggggaaacataaaattcttgccaaattccaggggttcagtctagcttccactgctcaccagggcgtggaaaaccaatccctgagatgagtattgccagggaggaaggtttcatttggatgacgccagccagagagattggagcaaaacctcaaatctgtttcttcttcctgcctccaactaaatttaggggtgtatatagcagggaaggaaaatggggctgggagggcaagaaagaagagttggtcaccaggcagcaggtgcatttcattgtacaaatcataagtttatcaagcttcagttctgtgggcatgtggcttgttagaaaatcaggctactttcaaaagtagtcatttttctcagtatacacatataaaatccacatgaattaaagatgtaaatgtggaaaacaaacctaaagctttttgcaaatatataaacaaatacctttataacctcattgggaagggaaggatttcacacacatgacacaaacatcacaaactgcacacagaaaagataaaagtcactgtattgcatttaaaaacgctagttcatccacatatgccatggaatactatgcagccatcaaaaggatgagttcatttcctttgtaggaacatggatgaagctggaaaccattattctgagcaaaatatcgcaaggacaaaaccaaacaccacatgttctcactcataggtgggaattgaacaatgagaacacttggacacagggtggggaacatcacacaccagggcctgtcgtggggtggggggaggggggagggatagcattaggagatatacctaatgctaaatgacaagttaatgggtgcagcacaccaacatggcacatgtatacatatgtaataaacctgcacattgtgcacacgaaccctagaacttaaagtataataataattaaaaaaaacactagtgcatcaaaagaaatcttttcaagtggaggtgggggagggtgagttacatatggggagaagatattctcagcccatagaacaaaagtttgtccatccagaatacctaaaatatactacaaatcagtgaggaaaagatgaacaaacaagtagaaaaataggcaaatgatgtaatccagcaattcaaagagagaaagtccaaatggccaatgcatatatatatatatattctcaaactttattcgtaaccaagaaagtgcatattaaaactgaagagagacatcgttttatgcccatcacggtggcaaaagtggcagcatgtgacactgtgatgggctggagacagcggcggtggcagctgtcacacatagctggattaagccctggaaatttgatgagggggcaatgccagcactagatatagaattcatttacatattaaaacatatataaaagaatgtttgctgcagcattgtttgtaaaagtaaacatttaggtaccatttataaatgcattagtggaaggatggataataaattgtaggatgatattatagactactacccagtggcagggaaaagctacagctatcagtgaattaacaacacaaaattaggttgcaagatatattgtatggtgccatttatgaattgtaaaaatgtaaaacaatgacacatttatctagccagatgtaggttaagatagccaaagccagtttttaaataagtgggcataataaacactgagtttaggctggtggtgagctctgggcagggagggaagaaaaagcaagtagattgaagtgggcaagatttgtgactttttctttttcccgagacagtgtcttgctctgtcgcccaggctggagtccagtggtgtgatcccagctcactgcaacctctgcctcccgggtgcaagcgattctcctgcctcagcctcccaagtagctgggattacaggtgcatgccaccacgcttggctaatttttgtatttttagtagagatggggtttcaccacgttggcaaggctggtctcgaactcctgacctcgtgatccgccctcatcagcctcccaaattgctgggattacaggcatgagccaccgcgcctggccttttttttttttttccccttttcttttcttttttttttttttttaacttttaagctcagaggtgcatgtgcaggtttgttatataggtaaagggtaaactcatgtcatgagggtttgttgtacagattattttattacccaggtatgaagcctagtacccattagctgttttccccattgtctccttcccattctccgccctctggcaggcttcagtgtgtgttgttcccctctatgtgtcctgtgttctcatcctttagctcccacttataagtgaggatatgcatttcttaaaagaatgttacactactgttgggatatttttctaagtctgcttttttttaatcatccagaaggtgtcaaccaaaaacttcctggtaataaccagtactcctattcctgcctgagtggctttcctgtgactggactgaaacgtcctgcagctgtggttgaacgagggtgacagccaagtttgcatggcacacacatcatgactgctgcctgacccacagacaccacacagtacaggcttgtttcagagatgccaaatgtggggaaaatgcatcttaaaagtcacagaagtaaatgtagtttattaataaatgtaataatgaataaatgattaattatttcatttataaggaggacggatgaaagaaagagaatataaatgcatttattaccactgaactgtatatgtaaaaatggtaaagatggtaaattatatatgcatattttatctctatttaaaaaatcactgaaataaatgtagtttgatcagtatttgtttcaggaatatttctgcagcttttttgtttgtttttgcttataatttttggcctctttttcttctttatattttgcttttattctcctgttgttggtataaaaagataattcatccaatcttaaagctaggaacatttttcttcaaatggcaaaagtttagtaatataaaattacatcttctttgtggctataatcacgttacttagttcttcagggaatgatattttcatatgcctaatattttaaatgtttttaattgattttcagtttcccaaggaaggagaatctcctttccaaagaggttcctttgtgattttggaacagaaagtcaatagtacaagcctcaacattacaagaggcatggtaggttttctgttggaaggtactggagacagatgtaggatacactgcatttttcattttacaaatgggtagcaagagatgctgtgtaaaattgatgggtacattacttaaggttcttccagctgctatagcaaataaaccctgtaatctcaatcttttaagaaaatagtagtttctttctcaattgctcaaaataaaatttattttattacaataaaatacatcagttatttagcagaggccttcagaatgctgaatcaagaacccaggtccctccaccttgaacatccatcatctctgaagattcaagaatagtttaattccaactttagaatgggagagaaccagagagttctcagaaggcatccccggatgttttgaaggccaggcctgaacctagcacatacttctgccatattccagtagctagaacgtagtcacatagcaaaggaggccaagaaatgtggaatagctgaagagcagccgaaaaaagaaaatcagtttggtggataatgagcaagtttcttccaaaatggattaaaaaacagtgttttaaattcattagtaaagtgataatgtcaatttgaaaagatgatacaggaaaaattggtaagaaaaggagaaaagaacaattgattgtggaagttagtggaactctttgtcttacagctgagaggtgatggattgtgtttgaactggggaaataaggaagtggatctgtgttcctgcttcctgggcatacagagctgtccaccacagaactagcattgacaccggcaaaattgcttttctctgagaacttggagagagaataggggtcatgttggatttggtgatgatagtgatggtggtgatgaggaataatttatatttttattgtaaattttcagtaatattttgaatttttattttaatatacatggataactttaataattacataattaatcacagtaaaagtggtaaaatacaagctgaaaattaaatccaaggacagagatccacttaataagcaactatagacatggaataagaatattttttcataacttttattattacattagcaaatattcatatttttaagaggaagtgcagagtagaaaactacaagtataatctcttttacataaatactatgcatagaaaagactagaagggaaccacaggtgttgttttagtatatttatttatgatgaattatagtctttatttttgcttatattttatctttgttgtcagctatataatgagttgtattaatgtctatacttttgtgtctaaaaaattgaaattgaatatttcattgtcaaaaactaagccatgacagaaagcacaataacttaatagtgaagtagagttcagggtgcttggaaccgtagctggctttgtctaatggtgagataatcattaggattagaactcaagagccctaggtttccatcccagatatgttgctaactaaatgtgtgaccctatgtaggtcactttatcagcacctcggtttttcacttgccgagtgatgttcgcattttcatttcctacaacctgagtattttaatgcagccacgaccctggtgctgcctgttgaaatgaggcagattaaagaccacaaggcctatggcaggaaagatgcttctttttccacctccagtgacaagctctgtgagatgaagtaaatcttctaattcagtcaaattctgctgctggtggcttttctccattggtcatatttatacagctggggacctacagcgcaagcctctccaggggagcccttcaggtcttctgtagctaaatattcccaactctccctctccatgtggctcacgggtttgccatttcctcatcaggttggcttatgcccaagttagcacccttatatattctatatcatttgatccccaaactccattttttccactcagttatttctgtaggtgagctgctcgcagtgaaaaataggaaagggggggaatcttttttttttttttttttttttttttgagatggagtctcgcactgtcccccaggctggagtgcagtggtgccatctcagctcactgcaagctccacctcccaacttcacgcaattctcctgcttcagcctcccgagtagctgggactacaggcgcacgccaccacgcccagctaattttttgtatttttagtagagacggggtttcactatgttaaccagactagtctcgaactcctgacctcaagtgatctgcccacctcggcctcccacagtgctgggattacaggcatgagccactgtgcccggttaatcattttgttttaaataagtttcagttagaatatagagcttcttccccaaacagagtaaccttcaattctccattttcatgtaaaagcaggtggcatttcttgtacactgtggagatggtatgattattaaacagctaataattagaaagcattccagaaataaaatcagcatataaatacctagtatgatggggatgattaaactaccggctgtggtggacaaaaaataatattattcaattgtttacatgcatttagctgatctaacaaaacatacatttgtaagatcccagccagaaatatttccaggtaataaaatataaattatagtgttcctttatggattgcatactttcttccttctttacgtttcaaataaattaccttctatgtatcacttaaataacatcaggctttctgaggtgcttaagacaatcttaacagtactgagttaaaatatatctttaacatgctattttttctagtctttaggaaagcttcactcaagtgcattttcaaaggtctttgaagatgaaatattctgagggcctcgtgcattgctgctgaatttaatagtccttagcaatcacactgaaatccattccctttgccctcagcttcccttcctaattctatcacgtaactaccttcttcctcaaaagccttcttaccaccttagcaaaaaatgacaacttggatttcagtgaaaatgtatggatttaatttgcaagctctccagtcttggctttgctctctgtgagtcttgacggaggggagaagctacaccggaagccctaagaagcctggcccaggctcacctgatctccttctcttccagaagcctcccaggttccagcccactctcaccttccacagggggcctcttgcctcccggcttctgcccagttcagccaatggaagtcaggggtgcgagctctaagcggggggatgaagagttggggttgcaggtgggtctggccgctgccctctgcctcaggttcccacagacagccctgtcctgaagctacgagatggctgaaagacaacacaattccccagtccccggcagccgcgcatttaatttccactcacagttttgccttttccagaatatcaggaaagggaatcatgacggatatactccccggggatcagggaagaggactcagggtgtgaggggttgtctgggagagctgggaagattccatgtcttgattgtcgtagccgttacatgactatttacagtcgttgaatctgcatgctgaaaagggtgaattttattgcatgtaaattatgtttgcaaaaagccaactaaagagtgagaaataattatgtctgttttcactgcagtcaattcccccacgacaatagggggattttcggaagatgctttgatatcataactctgttgtgcattgtgcattttcataagtcattaatatttataggccagctaacttcatccctcttgattttgattattcaaggagatgctaaacaaaatgtgtttcaggagaaactcacgtgtccacagctttccgtaccattggccaatctctgggtggtcctcccttttcaattttctaccctatcacatcagaaataggtattggggttgggcgcggtggcttacgcccataatcccggcactttgggaggcctaggcgggtggatcacttgaggacaggagttcgagaccagcctggccaacatggtgaaaccctgtctctactaaatacgcaaaaattagccagtgaggtgatgtgagctgtaatcctagctactggggaggctgaggcaaaagaatcacttgaacccgggaggtggaggttgctgtgagccaagatcacaccactgcactccagcctgggcaacagagggagagtctgtctcaaaaaaaaaaaaaaaaaaagccaggcgtagtggctcatgcctgtaatcccagcactttgggaggccgaggtgggtggatcacctgaggtcaggagttcgacactagcatggccaacgtgaggaaaccccacctctactaaaaatataaaaattaaccaggcatggtgggcgcctgtagtctcagccactcgggaggctaaggtaggaaaatagcttgaacctgggaggcagatgttgcagtgagctgagatcacaccattgcactctagtctgggtaacaagagtaaaactccatctcaaaaaaacataaaaataaaaaaaaaaagatgtaagtattggaatgtatgtcctccttggtggctgggaagctttcaagaccagattcatattcatgaaggttttctcttaagtcagctgagtatttctttggcaatacgattcctcaaacatttaacagatttctgatttatttgttttccctgaattctaaggactagtatctacacccaaagtttggcttcaccttctccagtgtgcctgagttcatcacccctttgccttctctcagtccacagcaactggcccgagacaacttagaacagtaagaggggaggcagcactctcatcagagctgtggcctcagtcacgctactcagctgagtagcttcgttaggctttgctgtgggaagcgttgtgacaccccatctgtttctgtttgggttcaagaagctgacaggttttctaaacctcaaggtcctaaatttcttgatactcctatcttcctttcattttctttgcatatatctctttcctgtgctcgtctgtgtcttctattaatttacactgttttgtaatgaaaaatggtcctgttctctcatcttggagagaccccctttaaggaggaccacttatgaatcacctccaaaggctctaccgtagatagacgtactgcttgctccttccattcctattcccaatcccctttgaagtctcctctgacttccccagagattctcaggctgctatggaggcacagctgatgaaattattcatatagaattggtacacagacatattatatttgatgacagtcggttatcttccctccattgtaccagacagtgccccttagggacatgcacatggcatcttgcccatttttttcttttgttttgttttcttttctttatttttgagacatctcactctgttgctcaagctgaagtgcagaggcatgatttcagctcactgcaacctctgcctcctgggttcaagtgattcttcggcctcagcctcctgagtagcagggattacaagtgcacaccacaacgcccggcaaattttttgtatttttagtagaaacgaggttttgccatgttgtccaggctggtcttaaactcctgagctcaggcagtctgcccgcctcaacctcccaaagtgctgggattacaggcaggagccaccactcctggccttttgctcatttttctaccttctgtgtctaacttactgtcaggttcataggaggcacccagtaaatattggccaaataaaattgtcttcatttacaaaagaaaaataaaccttgataatatgtgtaaattgttaagcatgcttgcctggtaccataaaataatacaaaatagccctgcacagtcttttatggagatgtcttcatataaaggcagcatagagaagacagcacattgactgcatggtgacccatcggaaagtgcttttaataccactgggaaactgaactgccagggccatctccaaggaagaacaaagcttcagagagtgtgtgggattggagtagatggggaaatggatgtagggtatttcaagctaaaggaaaaacagataaaagtcagctttgggaatgggcctcataggttggggaataacaagacaacctgcccaaccaaagtgaacacacatttgggatagaatttaggttgcctgaactgctttggatttttctagatatagaaaactaggctatcttttttgtccttctgtgtaatctcccaaccctagttgtcattgtatccattgaagaatggtctctctgtgtccttgggatgcttatatttgctccttttggtctgcgacatttttaaagagttgcaatttcctgttgtttgcatacatattctgaaaaactgtatttatgttaatgattagatacaaaaggtttctgctaatatcccccacctgctaggaaattaatttgggttctacatttgtctagaaagggtctaagtattatcaccctgattaaaaattcacctaaaaacttctgtgtctctgtgttgcatatagaaacatcaatatggcttccatatgcacttgttattggaggaaaaaatagattaagaatcccaatacattaatgatagccatgaaatttagctctctgctgatctttgcttaaaaattatattcagcaaatatatatatatatgcacacacacatatatatgcatacatatactaacacaaaaataattttggcatatagatgggtgtaaaagtgaaaatgtaactcatttattcaaatgtgtaagctaaacgtatttggaaaaataaatagaacagtgaaaatcattaaaattaacctttatgacattttctgggaaatttatgactaccaagtgttgaagaccatgtttgaaaagaaaaaaaaattagaaggcataaataaaaaagttaagtcattaaatgataaaatattctaaagaaatttaagataaggtgacagaatacaagcatggtaactttcttaacttttagaagaaaatgtaacactgaagtttaagttatgccaagctataattttaacaattttcagaagaatatataacagtgtataaaaatatccatgtagcagaaagaaacacagacaacaaaatgaatttaaagtttatgtcatatgttgtacttgtgcttctgggtagacggagtagacatccttttctccattcctcccactaagtgcagctaaagccactgggcattacacgtaaaacaaatgtaagatgactctgaaagaaggagggaagaaggcagaccacctggggagcttgcgactggaggaagaaaccaggggtgaattccttgggttttctttttgccttatatctccagactaggtagttgagaggctgacacaaaaccctagtgtgtgcaaacaaacatgccccaagaaatgctcatctcttgccaaagaccaaggaatgggcaatctaagacagcggccactctagtccaacaaggaccacataggacaccagagtccacttctggtgccacaaggagaagtcgactggagagctttgccaggctgcaatgtggccccaaactcccaccaggatggcatcagaggaggccaagtgagagacttcccacttctacccacacagtcaggggctgcgctccccgtggtgtcaatgcagaccctgtagacagctggacttttacctgcaccctgtgtaacaaggtgccccctaccctccactgggggttgtccaaggagcctagtagagtcgggatggtcactgatgctcggagataacgaggcccctgccctagagtgtcagtggggactccacaaggagcggtgatgagcttctttgcttctggccatggtgttttgttgtgggtagtggagggtctgaatcccacatcaccccacagcagcaagaagcccttcctccagtgccttccaagaccaagtgcagaacctgaagtgtccctccccactggcagtgtcatgagaggcccacttcctctgcagtgcagtgtccgagagggcctgcaaaacaggacgcttaagtaatatcttgggtacccaggggtagggcagtggagggagacagtgtgactgtggcatagcaggagagagggcttgtggtggggacgcagttccatgtcttgactgtgttggctgttaatggaatctacacgtgggattaatgacccaaaatgatacacgcacacatgtagcattggcagaagctgagggaagggtgggcacctgggacccctttgtactatgactgcaattctctgtgaatctatcattgttttaccaagaaattctttttgaaaagtatatgccatgtgtcagagatggcataatatgattgttattatatcaataaatgtgattaggataaaacttttaattaggaaagaaagtatatctgattaaagagtatattcctgcgcaaaatatggaaataggtatgcaaacatgtttgtatgtgcgtggggaattttgggatggatacacaaactctggatagtggggctgataattgagaagaagctaggaatttgcattttatttctgcctttctatactacttgcaaattttactatgggaactaatcactttcataattgaaatgagctacctgaaggctgtaaagaaagaaatgatcttgaaaacataatattttaaaaatctgcttataaataatactaaaaccaaattgaattaaaccacagaagtctggatggggaaataatttgaatgcaaggtacatagaatatttgaatatatttgttccaaaattgacatttttttgggtttctttccaatcatgcccagtgtgtggtacagttacacagatacatcatggttgtgcatttgtcttgcatctgcgtagctagttaagcacaaaggcaggcccaggagccagtgtagaaacaatattttgcaatttgggaggcaagaaccttcaagcaaattattataaaacactcaaagtctttcctggggccatgttttggctttcgaggtctgtgtaattgcttgtcctcctcccttttattttgagacagagactcgttctgtcccttaggctggagtgcagtggtgcgatctcggggctcactgcaaactccacttcccgggttcaagcaattctcctgcctcagcctcctgagtagctgggattacaggtgcatgccaccatgcctggctaatttttgtatttttaatagagacagggtttcaccatgttggtcaggctggtctccaacttctgacttcatgatctgcccacgttggcctcccaaagtgctgggattacaggcatgagccaccacgcccggcctgtcctcctcttttttgtctctctccttccctgatatttggcactttaagatttctgtcctcattcattctactgtgccttcattccacaaatcaattgttgagcatttactgtgtgacgggcagccttctgggcattgagaatacagctgtgaggaaaggaatgccacttctggaacgcagcgtgcataccagctttgggtggacctctgatggccacttttcattttaccacgcctcagtctcctagacaacagtgtggtgtccaacagggagccggaactgggtggatcagattgttgtcagattgaccgattgtttcgggtactctttacctgcaaccttaggcatagacagcggccaccccttcttataactgcaaggagctcgtgcccctcatccactgtcaccaaatgctactctgtgattctatgtgccttgccatcaggcagccacgaggagggaagctgagatttcatcggagaagctaattggggcatggaattgtattttgaaacttgtgctccattttattatgtgtttataggagactgaaacagaacaaggaaaaacaaatttgggctcaacaataatgtacttgtctcctggttacagctttaatcatgtattaaactgtataaatctttttcaattatattaatttaactcactatcaatggcagtggattgatggcagaacattttcagttttcattgttagccaaaaagccctcagcgaagtaaataacttaggaagaaatatgtaactcttctctgagatgagcttggaagggtttcaaagctttggtcattggattttcattatttaccatagcaaaacctgctgaaagagcacctaatgctaaataattccttcttatactctttgtgcacatttaaaaaaatgaaacagtgattggcatggcctaacacaggtctttgattaatggtcttaagaattttgcaagctttctcaactttccaagagcaatttgacctatgaagacagcctttggtagacccacaaaggggtccacagagatgaagaataagaagtgtctgattgagcatggacaggagctctcttttctctccctgttaatttcgaattggccactgtttaatcattcttgtgctcgtgcttggtaacagtggctgtggggctggggagtgtgctgtgttacacatggtccatcatgagtagaattttatctcataccgaatttaatattcttatgacttaagaaacagaatcgcaccagggataacaatagcttaagatatatttcacacattttgtctgaagagcttaggcaagagagaaaatacgtcattctattaaatactgactgcttcacttccaatgaaataacggattgattagcatttcctaagcaagctgttctgcatttatttgattcacttagcgtccatacatataactgatttaaacttaacattcttcctacacttttacagatcacatcagggaaaaaggaagattttcatggaataaattaacttacactaaaaacaatttgagcacagaaacattagcagaatgaatatttatgaatttgcaattaattttaccgattttattgtgtattacttactatgtaatatgtgactaatttaatgtactcatttatgtaatagatgtctacagaggaccaacaaggggcccagcactgtgtaagtgccaaaattacaacaataacagtggcaaacaaactccctattttcatagcgttaatattctagaggaggagctaacatttccaaaggcagctccacgttttctatgacctataaagaagaggtgagatgatgttgcctgcatgtggctgagtgaaaggcagccagcaaagacctctcagaggaaggaaattgacacctgacctgaagcccaagtgcatgaagaaactaagctacgaagagggacagagaggaggtcagtgaggctacagcagggggtggcaaacgttttctataaagggacacatagttgacgattttggatttatggcccagacagtctgtgtcacaatgacccccttttatttggcaagtaaaaagcagccacagtaatatgtaagctattatgccaataaaatttatagatggacaccgacatttacatttcatataattttttgtgtcacaaaataatgtttttttaattttgttatacccactgaaaagcataaataccattcttaggtcacaggctgtataacgcaggcagtgggctgggtttggcccatgaggcgattgtttgcagacctcgggccaaagaccagagagggaagaagatgagggggctgaggtgggctctaggtcactgtagaccttagagaaactagcattttgttctaagagaattgcaagccatggagggaatttaagcagaggagaagcggtctgatttatgatttcataaagttccctctggttgctgtcatgagcgcctcataataggcaagtgtggaagcaggaatgctgtttaggaggctattctaagaggctacaggtgacaggtgcagggtggtgggggtttcaacccaggtgagagaagcaagtgggtatgtgagtgtatgaacataccatattatatctgttcttcctctgcagcctccagcctggctctttaaataatcaaaacttatggttgtagcaataaaaactagcctactttagatttcagcttaattatattaccaaccacatacatgtttaatctcttcttctcgatttaaacgaaagcaaggacaaatcctctgttctctgctggtaaaagggatatgtcaaaatctccagccacgagggggctcctgtcatcatgcctcatgtgttcataactacaatttatgacgcctccttctgtacactgatttcagttgaatgcttctagagaatactgttgaactgagtctgatgatacagatgtttgcattttatgaaaaaacaacattctaatgcagttcatggatatcctccacttttcacaagttgcttttgtaggctagtggtgtgttcttccccaggcagtttgcctgatgccaaggacttagatacatcatttgccatcagtggaagtctgaataggatggagggatatataaataagtcaagaatgcgtgacccagagtgacatattatactggaatgatggtataccatgagaatatgtggcataaggtagttagaggttttgatgtcctatgtttagcagtgatttttttctgtaagcacacggttgttattccaaagataatatgtactttcaagcataagtgactttatttcaatctatagtctctttgagtaatttttattcttccatttccaagactcatgtcgtgttggggcaatagagatagtgtactgtagaactgttagaatcccaaatgcctccccttgcactcatggaagctcagatgtggggtggtattagaaggatatacttgcttatttctcaatgtgacacagctaaggtgcatatcattttcctttgccgtgtatggaaaacttagcactcatcttcaacatttgtttagagatttgggctacatggtatctctggttgaggcctggcagttttcatggcaatgcgaaaatgttgattgaatgacttcctaaagtattcatctcttgcctgtgcttcagtggaactgcatgcacgctgcaaaggggattttccagagttgtggatgcaactaatctcctaaatagatctccatctctagtcctccatcacccaactccactcatgtcatacgcaatctaaaacgtaatcctctttttgtataggcataagcatgatttacaaactctcaagatttaaactgaaatggaaacaataaaaagggagaagccagccgggcatggtggcccacacctgtaatcccagcactttgggaggctgaggcgggcggatcacttgaggtcaggagttcgagaccagcctggccaacatggcaaaaccccgtctctactaaaaacacaaaaattagccagcgtggtggcgtgcctgtaattccagctactcaggagcctgaggcaggtgaactgcttgaacccaggaggtggaggttgcagtgagctgaaattggagtgtcactgcactccagcctgggcaacagagcaagactctgtctcaaaaaaaaaaaaggtgggggtgtgtggggagaagtcaaattcacctatctggctttggaatctctctacactacatagttggcatgcactcatgtcttgctgtacaacatggtcctaagtaactctatcataggactgaaaaaccttggctcacgcatttcctaccagtgggaccaaggacaatgcattctgctttcatctctgcagcctttaagacacagctaaccctccagcataaggatttccatgcctcacattgtcttaaaatatctgttgtactttttgccttgtactttaaactcccaacttcttggttaatagtgtgagtatgggccaggtgcggtggctcatgcctgtaatctcagcattttgggaggccgagatgggtggatcaccttaagtcaggaattcaagaccagtgtggacaacatggcaaaacccggtttctactaaaaacacaaaacttagccgggtgtggcagtgggcgcctgtagtcccagctactctggaggctgaggcaggagaatggcttgaacccaggaggcagaggttgcagtgagctgagattgcaccactgaactccagcctgggtgactccatctaaaaaaaaaaaaaagtaagtacatcccatctcctcctaggaaagattaaaatatatttaggaatataatggtaaattaatttctttctatgctaatactgtcagccatggtgtagatctggagcaatgtgcttaaccctctgggcctcagttttctaagtcaaaatttcctgagtctcagttcatttatatgtaaaatgaggataagaacctccactttacttgcttcttctaaaggttaaattgtacaataaaatgaagagcccagcagcatgtcacgcatcagggattagcatagttgcatatcaccttttggtttacatagaatttcacaaatattatctcatttgattcttgaaacaatgagatggccagaacatgttgttttgcatcattttatagttgagtaaactgaagtcaggagggcctattagcaagctgcatttgctggaactgcctattcaataattatttaataaataaacaatttagggcaaggagaatgtgtcttttcatatagagaaacaacgtggcaaatgttaatccagttaagtaggtacatcttaatgctaaatgattattcgggtaaatatagctggagcatttgtattttcactcggcaataactattagcaagtactctgtacaatatctcagcaactcaatacagtgcaaggctcctcttgaggaatggtagtattaagagagaagtaagcaaaattgacaaggaagaacttgtttatcttggctaaagtaacatgtaggtgccccctcattcttgttatatatgcagataacagattataaataggtgtgatgttagtgaatccagaggggaactaatggaagaaaactgaatttatttctgtctaacatattgtttcttgtcagtttccttcctttgtaatataatttttaacaaaatgcctgacaagtaatttagtgacagatgtgattaatgctgacgtggcttttaagtagcagtgaacagttagaggaagcattgttgtaaaaataaaggctgtcttcctggtgtctttcaaatacctagaaaactaaaagactaagtttgccctctactggaattcagaattataccactggcggttttatgactgtgtggaaaaaaaaaaaaggatctgtgtatttttcgtttccaggttacaaattcaagcctccttttaccaccttggttaatccgctttagtattagttctatacatacataagattctgtgaaccaaatgctctcaagatagaatttccattcccatggaagccggctgtgagggcaggtgatcaggtgctctacacaaggattacagcaggaattttggctctcctactcattttgcaaaatatgaataatcacctaacacacagtctggggttttagtagtttttgattggtgttaggaacttaaaataaccccaagaataaaattgtgccagaacctagaacatcatccaacgattggttttgaggacagacctaagagcagccaaaagggaaagggggtgttacggaggcagaaagctgcttactggccttttctaaaaactgcacttccagttcactggctctgagcatgcctggtacaacagtccagggggtggaattattacggcagctgccctgggaccagtgccagtagaggtctggagactctagggaagataaaggtcaaaaagatggatcacaagacccgtcagcaggaagtaaagctggtttaggcaaagcaaagtgcagccctaatttgtcctctccttctggctaaacatcatttagtcttcctcttccttatctgatctccaaacaccaccagccaatgcctatattttgttgtaacatgaacatttatacgtgcacactcagtggtgcacagatttcagaaactggaaaataggacgtttgccacgctggaggccaatgcaaatcaacaaatcaaacccttgtgtgcctctttctggctcagatctttttcacaatttatcgcgtttggccaaaggttcagagagaaaatagatgcaatattatctatcaaagctagagtgagcatttgtacgtggggtgggggtacagggggaagaagagtgcatcccagaccctattttactctgatatttagactttagtatctaatatagcagtttgctctgattttaaaatagccagggaaaagtgggttcaaaagttacctatgcctccataaaggacattatataatttatctttgctggtcctctggaatagtagaaactggctcctattatctagatcaaggtgttttattgtaaaaagagaataatgacatttgttttctcagtttgtagaaacatagtcagtggattaaattttatacatgtttgagctttctctcaatatttttcataaaacgtaggtagcctgccagtacttatccctaccagaatgaagcttcttacagtctctgataaggcatgatgcatgttttgatgtaaatattttaagtttattgtagcatttcatgcccatgatatattaaaccaggtcatgaattccagggctctgccccatgaacaatattagactcactctgacttccagttaaaattactccccaggttcagataaattgtgaaaataaaagatacttggattaccctctatcttgtggctcataagagagtggctgctgcggaggctggtccagcagcatccttggtcagtcagggccatcggtgtgcctacatcccaggcggagggatgcaacgtgctcattgtaatcatcatgccacaccgccaagaaaatatttgacactgagatcagaagacagggattcatagagtttctttttagatcataatcacttctaaaccatggggggttaaataggattctccttcaaggaaagtgaaaacttttgaggtgttttctttctcaaagtatacaatttgtccattacaatgggatggtgcacaattttatatctactaaaaatgtgtttttttttgtttttaatccaggatattcacagcaatagctgccaatgtttggccctcaacaatgggtcacaagtattatgataactaactaatctagcatcgctacaattctgcaaggcagatgttcttgcctcaagctttagttaaagaaatagaagcccagacagcttaaataccttaaccaaattcacttagctaatcaatatgagacactggattcagactcaggtttttccaatactcacactcatctttgtgccatgctacctttccaggaaacctgttaattaaaaatcccttttctactcagaatatatacttttcaatgctaatacagaccgattttcctactgtcttattgaatgtatagagggtcactggtaacatcaaataacaatgcccttttccagatctttgtagttttttctttgtttttatttttgttttgagacggattcactctgctgcccaggctggagtgcagtggcaagatctgcaacctccacttcccaggttcaagcaattctcccctcctgagtagctgggactacaggcacctgccaccatgcctggttaatttttttttttttttttttttttttagtagagatggggtttgcccaggctggtcttgaactcctgacctcaggtgatccacctgccttggcctcccaaagtgccgggattacaggtgtgagccaccatacctctttgtagttcttataaaagtccactacctgtgtctcaggcaggtattattgaagctagttttgggaagagagctacttcagaaaagaaaggcaagtacaatcatgaacaggtgtcataatagggccagtataaaatttctcaagatggtaggaaaaaaatgtgtctacacgttaaaccacaaacttcatactgggcatccaagaagtggaccagaaccaggaatcccatgcataagggttccactggattccacactccaagcagcagttgactgttgagtcaaggttgcaagggaccagagtccacagccacaaacccagtggaagggtggggaattctgccaaagagagacaatttctctctcctccatgctaggctgtcctctgtgtttcagtggagatttcagtgaagaattcagtggaatttcttcaccctgatgttgaaattagcaggaagttacccctggataataactctgcccctgattgactcaggtagaaagaagtgagaattgtgttaccatgtaactattgttgaaacagcaaggtgaagacaaagggaaacatgaaaataagagaaagagaatgggatactgagtaacaaaggatgtctgtgagaatcattgagaggttccactgattaaaataacagaaaccaagttaagagtgaaatagcgtatagtaagtattttatgtcacctcattccatcttaatgccttggtgtaagaaatgagaaacgttttctgaaactgtaacaagcaaacagttaatggctaggtcaaagtactggaaatcacatttggcctgcagctgatttttccagcagatgacatttgctttagcttaaactaaaataaaggaacattattgctctgattgttccagcttataagtgaaattctttcccacttaaaattgaaaaattaggagcattcctggcacgtgaatgatattcagtacccaacaccagtggttctcaaatgtgccatttgagtcagtttctaaacgttgttgaaactgattgctggacccacctccaaagttcctgattcagtagatctagggtagagcctgagagtttgcacttctaagaagtttccagatgctgctgctgctgctgctcagaggaccacactggcaaccactgctctacactaatgtgaaccgtggcatgtgtctcgctatctgatgttactcttctgttttcccccattggaaacaacaaactatgaggaaaaaatatctgaattcttacactggtatcattgactggaaaaaacaaatagtcattaatttgacaattgtcatcttttaatttggtgggttaaaatctgacaggatgtgacgccaaggcatttcatccttagtggtcccttcgaggtttcacacattatttctttgctgagaccttgagagcacaattacttgccagaggttttgcaatgcaatggtgaggaatgcagaatgttgggttcagctgatggaccctgaacgctaaccagaaggcacacgtgtgcacacttaggcttagagtcctcttccaggctgactagtccaacctcagacagccacaacagtagggagaagtcccactgggcaggctcctttctgaagtcacagctgcatggacagatttctctcctacacctgaccctctggggtagaaaaacacacgttttcacagtagacatcaatagactctttcaagttaatttcatggaggaacctaaatcatcgcgtgctcatggatccagtggttctcaacctgtcctttgcatcacagtcacttggaggactcactggaaaacagcttgctgggaaccgcccccctgtttctgattcagaaaatctaggtctgattctaggatccaaaaatgtgtttctgattcccaagtgaggttgttgctactggtcttgaggtccacatttggagaactgtgggtctttatccaaaatacatagaagaattctacattgacaaagtgaagatgcttgttcccaaatgctggagatgtgtgattttggctttgtccaacaatgaaagctctacatagccactgtgtcctggagtccttatgagagatagacagttttattggttgtagaaatttgcaactttgtacaaggggcaacatttacacaagatgcacatttttatgaagatctcttctaaaattttgaataatattccatttcagtgtgcttcactaaacttgttgcaaacgtgatttcagtaatttccctactttcaattactaattgcattaaaatatcagagaaaaaaaacatactgtgcagcaactctcagtccaggaaagaatggatatgtagaaaggattttttatataattttaggtttataatagaaactatagaactgaattaaaatgtaatttctagtaaaaattcttactcttttctaaacgcaactcacacatattaccctgtaatttgattttggtacttgtatgaattctggtgttaaataggaattttctgagagcagaataaagaattaaaaaaaaaactgctctggatgctttaaccagtgcctcaaatgtaataattaatacttattcactaaatcaaagttttagctctacttcttcatgtagaaaagtgacttggaaataaacagtcagaactccaaatgtaagactttgagatgtaaagagactatctgaagctgaaatcacctgtcgggaaaccatctggatagagttctgcacttaggggattactgtaagaacttgaatatctacacccaaataattcatggaaaaagacagcggacatttctacctaggactcagtaactgttcatcaaaaggatcagggcatgggtaatatttgcctctagcaataatagacgtttccttccaccccggtccttacttaatataaaaagaagttcaaatgagggtttctcgtctgagctgagcctgagaaacaaagtgaaaggcaagcctgaggagcagtcaactctgtgtccagttcatttgtgaaatgagccccaatgaaataaccaattaaaagctccttcctgtgaagaaaaaccagcaaggtctggaaatagcagaagagccccaaccccagcacctgtcagcggcctgcggtttgagtctcaggcaagagtcacagtcattgcgtcaccaataccactcgtttcaccttaatggatattatgtgatgatggggattacttcaacatggtgcagaatattttggagaaatgaattcccaggcttcaaacacttaatatctcattgcttatacacaaagatgcattgtcgttttgaaagtcagaatatcagttatcactaaattatgtaagtaacctccaggaaatttcacaaggaaagtctcacctcacatgtgacaaatgatctggataattggagtgcccttcttcaagatccaagatttcgtcttgttgactgccctacctgctttttcatccccttccagatgccaagttcaggccgctcgaactcatttttcttgtgctgaatgaggcttgaattaaattctctaaacacaaattaaagggtatctcggcattaccaggaagatttgtgtcttgtgaaataatgggatggtttgagtcaaacgagtttgcaagaactactcaaaccaaattggttttgcccatattttaaaatcttttcacatttcacttatatttccacacaaatgcataaatcttaaagcaactagagtcagctggaaaaaagaagtgttctaagcatttaccgtgaagaacagatcgttaagaaagtaggctgaggaaaattgggaagaatgctgaaatgagtagcaataactgatgagctatgctgatctaacacactccaagaaaaagaagactagcagtcagttgacatggtgttgtttctttctatgcgttatattcgttttgcttaagaaatttcctaatacaaaataactgtgtcattcttcgtttctaactaaattcttctatatgattctctaatttaatgtgtgcccaggtttctcttgacgtttcattgatgatccagtggcaaagaagaagaaacgatactaagatggaaggagttattgtgaaaatgtacatagataaaagcaggaacttattgcataaacatgtcgttcctataaataaaaatcaaacatatatatgtaagtcttctgatcagtactgcaaatttgccctccagaaaggttatgcaagtgtgcagtccaagaagcattatttagaaatgctactaaacaggttggcattgctttgagaaataactcattattcgtttaaatagcatttttaatttagtttcattatatattgtttagttgtatttcttctttgtaatttaccattctttatttgcaaatcattttgactacaataatcaataattaatatatcaactgttataattcaatattcctgtagttaatattctcatttgccttataggtttttctttttttgtgtgagatacagggttttttttatttttctattttgcattcaatcttttcctttatggcttctgcctgtttaatcatgtttaaaactgcctgtctactgtaaaattatataaatgtttatcttaattacctcataatcattttatgacttcagtttttacatttaaatcttcaaaccatctgggttttactttaccgtggtaagaaggatgagatagagcttaatttttttccaaatgattagtaaattatcacaaaaccttttgaagtaatgatttcttcactgattgattggaaattcacttatataatacattattatttatagatgaagttattcagagacaaatttaagctcagaaatagatctaagtattggaagtaattttagaacacaggaggtgttctgataatattcaaatctcctctaaaaatttttcattgatatcacttgtttgagtatctccaagattttgatagaaagtattttttattggaagaaaatcgatgcccccactcacccacctgcgcatgtgtgcatgtgtgtgtgcacgcacatacacacatacacacaagcatgcacacacacacatgcatacacacatgagtgcatacacgagtgcatacacacgtgcgcacacacacgagtgcatacacacacgagtgcatacacatgcgcatacacacttgcatacagacacgtgcatgcacatatgtgcatacacacacgagtgcatacacacgcgtgcatacacacacgtgcacacacacaaatgcatacacgcacatacacacgcacatacatgtgcatacagacacacacgcatgcgcgcgcgcacacacacacacacacacttcttacttctctataccaaaagctaacaaagagtttctgtaaatgtttcaggctttgtggtcccagcctctctcacaactactgaactctgaggttgctattgtgggatctcgccagcaccccacaatgcaacggggctctctctttgttcccaggtggatcggcaggtcgagaaataatagacacacaagatagtgaaaactgggtccggggggtcaccacctcctggacctgagatgccaccaatgcactggatataccagcatttattattaagtttagtgagggtgggggtaggttagtgagggatttagggtcatttgattatgaggtgagatggtcacatggggatgaagtaattctttaacataacatctgtattcagaagtacagtatgcagagataagaacttacaatatagtgtgtgcattagcaatttctaacagagccttaaaacagaaacacagtctttccataacctatgattagcaagacattaatcagcaggaacagttgcagcaaaagctggttacaaacaatccatagaaacaggacgtgaagctagacaaccggtcagaccagaaattctcggaagggagtatgccttaaccctaaagaggcctagaagagctgcggcaagatgagggcgtttatagccctatcttatccatatggacaggtgccccccatgcatccgtttataggctctccacaagggtcgcattccattcccagagctatgaacatctgcttttctgggataggaatcttggtgatgtgaaacctccctgactgcacgtctgttcataggctctcttcagggggaagcacatcacccgctgttggctcattctggcagtccaacctggcattgtctttacacaatcctgcatgcaattttgtatttacaataatcaggagcatttcatcttttattctgtagcagtagtttcaggtctccctacaactccccctttactctgatttaaatgaaccatagcaatcatggcttggcgctgatcctgattggattgaagaatatttttttccaattttacacatgaacaataaaccaatagcacaaattatacacagaacaaaattaacaatagtggatcctcccaaagattttacccattgaatggggttgagattagataacccctcagagatacaaaactctgggtgacacccaatgaaccattctgttctaatcaaccttgatttttgtacattacaattagaaccattgatgattttaacatgtcaggaaaagccttttctttttctgatatttttttcaacaatttaaagatgtaaaaagcattcttagttcatgggtcatacaaaacaaatggtgggccagattcatccggtgggacatcgtttgcacttcaaatattggaagactcttatgatagactttctataatctgtagttggaaattaatgcactttttaaatataatgttttgaattggaatgggcacaaattatttgatgtgacttactatcaagttatataaacaactgaactctaaataaaaatataggctcttgagtgtggtagaagtaaacaaaaaatgtttgagtatttgtcacccatgtaaataaatttatgcatccttcaatgttgctgtgaaatatttggccatccaggcaccaggagcaatacaaggaggtatttagctttcatttttgaattaaaaagtaggacattcaccagaggaaacataatttagaaggaaaactttaagaagaattggctttaacagatggattctgttttgggaatgatcatcaatgtaatagacaatgtattgtgaatgattttattttacaactttttattaaaatgtactatattggaaatcttatattaagaatgcttataggtcaacctcgcttttactttagctataacctaatgtttaataattatagtagttttttcattaatatttcggtcaacatattttaagctagattattaggtttaaaggactgaattcatgttaccatatattgaagccctcgtttcataaataaagcttattgtcttaataactcttttgtctgacattaatatactgctataataactcttttgtctgacattaatatactgctaaacttttgatcagtttatcctattatttttattccatatcttcaatttttctcttatattttagatatgcctctcttaaacagcataaatctagattttttttacatttcatctaaaaatttcaatcttttaagtttatatttaaccatgactgtaattactgatacactggaattcttctatttttgtgcttttcatttatctgtcatactaggctaagtgtttcttcttttgctttactttataaaccaaatcattttcttttctccactagtataaggtgaaatattctatttctgttctcttgtggttacggtaggcattttgatatacatatttaatgtaataagttaaaatataatcaatttctttttcaaattaaccatgactttagactattttaactctaatcatattcatccctctctttgccctaaatatatttctgtaatgcccaggtttgaatgcaccttgatttaattatactttcattattttggattatttaattattttgattaaataatttcatctaatgatttactgttttctgtctctctgataaatacataaaagtagaaaccttgctcataagttagtgtatgtttaactttatgacataatacctaacatctttccaaattagttttatttgtacttttccccactagcacagcaatgtaggagagtgtcaggtgccccacatcttcgtcaacatttggtgttgtccattttaattttagccattctaatgagttttaattattttctctgataacttataatgtcaagcagcttctttttctcctgtactactggcttttcaaattaattattcccagaagtgtctgttcaagttctttaccatttccttattggttgatttatcttttggctattgatttgtagaaattatttatgtattctggatacaagtcctttgtcagatatatgcaatgtgttctcccagtctgctctttattcttctttctcttaatggtgtttttgatggacaaaggttttttacattgatgaattcaacttattaatttttttttgtatttccttctttatgtgtcctttctgggaaatgtatttaaacttattttatggcccggcacacattctaccttggtgaaatttcatgtatgtcatttttttttctgcctcatccaatctctattcttcttctgcaattccaattatatgtgtgttttacacttgacactgttctagagctcaaggtggcttggttctttttttttttttttttttttttgagacagagtctcgctctgttacccaggctggagtgcagtggcgcaatctccacttactgcaagctccgcctcctgggttcacgccattctcctgcctcagcctcccaagtagctgggactacaggcacctgccaccacgcctggctaatttctttgtatttttttttagtagagatggggtttcaccctgttagccaggatggctaccctcgtgatccgcccgcctcggcctcccaaagtgctggagttacaggcatgagccaccgtgcctggctggttcttttttaaaaatattttttcctctctatttttcagatttgacaatttgacttgttgctttatcttcaagtctatagactattgatttagccatctccaactgatgttaagaatatctgtgattttttaaaaaattcagatagtttctaatgttagaatttccattagtttgtttttatttttatttttttaagtgaaagcaggtttattaagaaagcaaaggaatgaaagaatggctactccataggcagagcagcctagtttatttttatactgtatatttccctgctgggattatccctctcttcactcacttatggctattttcccttttacatctttgaccatatttataatagtggtgtttgattctttgtctgctaattccaacatgttgatgatctcagtattggtttctattgatgtttgttctcttgactatgcataatattttacatttctttgcatatatagcatttttgtattgtatgctatactttggggatgatgcattctgaaaagagagtggattttgttatcttttgcagattattcatttttgttttagttaacagttacattcagggctgatcaccctgaatttatggagatttggttttgtactttattggggcaggctgtaagtatggaccttatagaattttagcagacactccaaagtgtctactaagcccctttaatttgaatggagttaaaatctaaattgtcttcctctgatgggcagcaattgaaatctatgtccagtttttttcatccatctatcgccttctatagggctgtttggtgttttttgcatgcgtctgcagttcagtttaactaaatatttatggggactttatatgcagacttttgtcccctcccatttctgggatttcccatctcaattcacagccacgttggcaatgtcacactctcttctctgttacctaaagccaacaggcctgtggttttctactttctcagtagctgcctgcctcacgtgtactgggaaccttgccaggcccaacccgcagacactggtcaagcgacggatgaaaaaatgtacgcagacacaggttttttgcctggtcgggcggataggggaccgggccactcagacatcaaggatgccataaagagtcacagcggctgaggccctgacaagctagcgctgagggcatttatttagtacagatttaataacaaaggctttgagtcaacacacttgtgggtaattaacatggtcgcccccccaccaatcccccaacccctacccccaccccagtcctcaccccgctccccgagagagcagtcctgcacgtggatgattaaaggccaggttctaaggcctaagtaaactaacttatctggatcaattcccttacacttccttgttatctgctcttagagaattcagctgccttttgccataattttcttctgaagttctgcaaacccctggccttctgagaaggtctgcattctctatctataatttttcccaccaccctgaccaatctcctacagaacactattgggaatctgtataaatatgggtctaacttagtgcatttctgtcttttcaagggttcagcttaactatacttttagcaattctctacaactgtcaaatggttttctttttaaaaaatttcccagagattataagtttagtttgatgtaggctactttatcattatgaaacccagaacgattcaaatcattattatagttcacaaaatctctcttaagctgtgttttatgtgttgttatatcaatcctttaaggtttaatttttgcttttgctttttatctttttatttctatgcattctactgggttactactaatttggctcaggagttttgatagtctcttgttctattgtcatactttccattatttcttttttctttaaatacattaaacagccattttattcaataatcccattgttttccatatcttaggtctaatacataaaagggttttttaactttaatttatgatggtttatgtctttatgtttatttgagatatttttattgtaagttccctacccctagggaaattaatctgtaggaattcattgagcatagaccttaaagtgcttgcctacagagaaaaacttattttcttctactgaaatatgggggacgtatccaaaattggattgccttgcattaatgtttgacttgatgttttataggccacacagttagtacaaatggagaccctaaacccagaggtggttagaaataattaccagagacatatatgttttctttttttttttttgaatactctgtagcttattgagactgaagcagacaattatacccacaactccctctgcagaggtgctttcctggttcacctgctgaagatgtcgtccttgctgggttctaacttgggcccttatcttccagccagccccccttattgcttggaaccaggatttgtctcatttcctgatgctccataaaaccctaggtaattctcccatattaactcccattaagccacctatttaagaaagaagaaccggttaatattttatccatcttttttttgaaatgccataaaaactaagttattccaaaagtctatttagcaatttttctggaaatggaagttttcctactggcttttgttccatgtgtttcaaggctgggtttttaagtacatacaaattttgacttttgaaaatgttctttgagaattcttacatcaccaacatgcagtattcttccttgtgcattacattgctatttacttgtattccactttgtttcatatacattttggcaaacctatcttctttttgttaacattttcttagtattttctttacaaacattttcattcctcctgtatcattttaagtgtcttttattgagttaaaaaatcaattaatttgtattctgtgcacaagaatccctctattatttaatagataaatttggacccattcataattattgagaatattaatattttgcatcatattcttgttccattattttgtgcctccttctcatgctttccagttactcatttttcacttttatattattacctgttgccgtataataatattgccaaacttattgccttacaacaacacacattagttttctcagtttctgtggtcgggagtccagacacagcttaggtggctttgctgcttcagggcctcacaaggctgcaatcaagatgccagccaggactgtggccttatcttaggcctggctggggagagatctgcttccacactcctatggctaatggtggcattcacttcctggtggtttgttgggctgaggggctccatctcttattggctggggggtcaccttctttcccatgtgggctctctgtatgacattacacaacatggtagcttgcttctgcagagccagcaagggagcgagtctactgccaagactaatgctacaacttcatgtaatgcaagcatacatacatctgtaacatcttccatattctattggttagaaggaaaccataggtcctattcattctcaaggagaaggtatattagtctgttctcatgctgctaataaagacataccctagattgtgtaatttataaaggaaagaggtttcattgactcacagttccacatggctggggagtcctcacaatcatggcagaaggtgaatgaggagcaaagttgtgtcttacatggtggcaggcaagagcttctgtaggggaactcccagttataataaaaccatcagatttagtgagacttattcactatcacaagaagagtatgggggaaactgcctccatgatttggttatttccacctggcccagcccttgacacatggggcttattagaattcaaggtgagatttgggtggagacacagccaaagcatatcagaagacatcacacaagtgcatatgtcccaggaggtaagaatcctggggctaccttcaagtccatctaccacatttcttatatcctttttaggacagatatcatttttttcctgtcacattctttaatggtttgaaggttatttacttgttaacatttctatttacacctatattttcccgacaatgtctagtgctgatcagattatatattcttcccttgaataaaccatataaccttagcaagcgtggagtttctttctcacctactcccactttcgccatttgccctttgactatttggtatttggaattctaagctgagaatttaaaaaatgtaaacataaacaatcagcaattatttgccttaaaactacattttactaaattacttgctgacttttcattaaacccactcattttctcttgggtttactttgtacatttcaaaatattgctgtcctcctctcattcctggatggtaccctgattaagtatagaattcttgattcaaggttattttttctttttgaatttttgaaatattactcccttcaccttttgtctgaaacattatgtctaacctactccatatgccaatctgatttttgttcctttgtacttaatcggatatttttcacttttgtaactttcaagcattttctttttatctttggctttctgaaatttgacaatttgatattttaagtttttgttttatattacttatatcttggtgtcctgtccatttataaagaataatttcaatataagtagatttattctccaagatctagagaagtttctttggttattctttgaatattctcctccatctttatttgctttttctagacattctttcatatagtactaatatcacaaatcccagatctatcttctatgtttttcatgctttctgaactttttcattgtttgactaagttcttgaggaattccaaagggtaatttcattgctctgtaatttacattttacgtatatcaaatggtatttggctgatacactaaggttttctctcaataaaatttttactctgcatgatttctatttgattttttacatctattattctccctcccatctctctgtgatgctacttatccttacactctgctttgttctttgattgtgtgttattcagcctttggagtttgttatttcatggtggcttctccctttcagtgctagatgaatcttggtaatgcattcagcagcattttctgttaggctcgatgtcagcacagcctggctgggaggagcagtgagatgtgctggagtggttcattctctcttccggcaatcatgctgtactagactgttgcgttgctctaaagaaacacctgagactgggtaatttataaagaaaagaggtttaattgtccccgagttctataggatgtgtggtgctggcatctgcttggcttctggggaggcctcagggaacttagtcatgatggaaggcaaagggggagcaggcatctcatatggccggagcaggagcaagagagtgggagctgccatacacttttaaaccaccagatctcatgagaactgactcactatcacgaggacagtaccaagggggaatggtgttaaaccattcatgagaaactaccctcatgattcaatcaactcccaccaggccccacctccaacactggggatcacaattcaacaggagattttggcagggacacagttccaaaccatatcagatgcacacgaaggacatacagtacacattgtgagccatgacaaacacaggtttatgtctgtgcttatttatgaaaaaaatagtttacttaccaaacacttatttatcctcttgtgaaagttagtattaatcctcttgtgaaatgaactctggtattttctattctgctcaatcgcattgcacttttttcacacacgagttaagtacttttttgattttcacacaccaaaatgcatctcgactgtggttgataaatactattttaggccattttcagtaaaattaaggaagagaacggacaagctatgaagtgaggagtatcaagagctaattttcaacatgtgggcacccctctatctcctggtcaaccccagccatttgtacacaatgccccatctctctgcataacacccaggctaattttacttaaaagagatacagctctgttgtttcagcctaggcacaaaaggaaaagaggaatcacagaggaatcaaatgcatggctataatgtcctcactaacatctttcaatttacccttgacccctcttctctgtctgtctcatcaggaagtgaagcatttcaggcttgctcccatgtctatagctgttctgcctgtgcacgtttgatatcattgcatcttcaacctgatctcgttcacttctgtttcagaagctactagtaatgtctgttctaccaagaattctcccttggattttacagtgttaaactgtatttatttatgtctgttatgtcatttctggggcttgaggcaggatgggtagctataatgtgtttggtttactcccttgaactagaaacctgggctatctttgccaagaaacattgttgtcaaccagaatttttgctgatttaaggagtatgctagtcttttatgatataactaatggaagcttctattaaggaaatacctctgtgacttgtactaggcctggatggaaggccatcccatcagagcttggaagtacgccgtgagacagtgctgatagacagagtgaaagtgctgctcaggaaaggaactcctggatctatgggtctcagtggacatggcagaatcatgcaattcaaattcaacttaacaagaaaacattgtttgctaactttaaaaaaatagttattcttttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtacaagtaccatgctgttttggttactgtagccttgtagtatagtttgaagtcaggtagtgtgatgcctccagctttgttcttttggcttaggattgacttggtgatcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcatccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaacatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtgggttggggggaggggggagggatagcattgggagatatacctaatgctagatgacaagttagtgggtgcagcgcaccagcatggcacatgtatacatatgtaactaacctgcacaatgtgcacatgtaccctaaaacttaaagtataataaaaaaaaagaaataataaaaataatacctataaaaaaaatattctttttcaatattattttgtttattaagttccttgcttttccatatggattttaggatccactcattaacttatacaaacaagggagcggggattctttcctgttcttatttatttgtgtgtctccattttctcccttgaaaattggacatttaaaataatccactgcgtgaactttggaaatcagatttccccctactttttactgtttgctgctgttgttgttctttgtttagaaacttcatgcattaattttggaaattctctattctttttcacatgtggtcatgaaggctttggttagcttagtgatcagctgatgattagacagagatttctagtcttattgatctggaaccaatagggctcccaaatctaccagtgtacttctgtgtgtgtttgggcacacctcaacactcagccagacattggacaactctgccttagctctcccttcctgcttaggaagtgcctcaaggtcagacagaggtgagagcttagagtcttcagtcattctttaccatacctacatctctgcatatgtacttggccttctagattcaaaaaaaaatatgatgtaacttttcaacattcctgtggaaactgcatttcccagtcttaccttttaagctttttggttagtctagggtttctcccaactattatgtagtgccataggtgactcagaagttaaacaattgcctcaatacatccaacagtgtcccccaagtcaaaggctttctgtactgggcaagcaccaaatcacatcatataagcacagctttgtgagcaggccctttcagagaactatcaggcaggtcagatcatgacaattctctggaaatgaggcacctcactgaaggtacctcaccctgttcctgccactccagtggcagctaggttggtggttttcactgtgtttgcagacaactggttacaaagactaccacagagctaggggtacggttgaggatgggaacaggaaaagttaaaacactacaaggtcactggtcttaccaaaatttggccattttcctggagtaaatgttctccagatttgtatgaggctttggttaaattccgtgtttctgaaaagttgattctcacaatttttgtcagtttttccatgacatttaagaggagaaaatattcagaggttcttcctctgccattttcattgacatcctatttacttttatttaattcataatattatgtacaaaaaatatttagtacacatctggggtattggctatgatcaagagaatagcttagtcctaaacataaccataagttaagaggaattctttactgtgggatttcatatctggtcctgccctatggggcagtttactgtgagtttacttacctctgagcctttctataaacacacctgccccatatcccattctcaagggatctgtttgctaacttaccaggtaattaatttagggtcaagtgctaatgactcataatggcataatatgtaatcatccaaatcacattttcaggatcgccaagggcttctgtatcttaatccaaaataataagcaatgtggggattattggctccttaagaagatcaatctctcttacatagaatgagctctgaaccagacacttagcctaagacaagtcagggtgatttgtggagttgaaatgtttttcactgaaaatgccagaatgttacttttttcaaaacgtctgaataatgttggatttcctatcgcctctaattcattgtctctgtttactttgcaagtatagaaaatattgatgaaaatgatcatcaatatgaaagtaaaatgctccaaattaataccttttttctatgacaaagaaacctttacaagtggaaataacttgtatcttcacaaggccacatttttaggtcacaatctggactaaagattttatctaaaatttttaagcatttatctttgcaaaatagttaagcacaatttttaatagttatttagaaaacattggccataaccctaatctatacttattaatatgtgtccttagaactcaaaggttttctctctctctctctctctctctctctctctctctctcagcatgtgtatataaaattgctggtgctagttgctatggtcaacatttaaagtgctaagcacaacacgaaatctaaaattctgtcagaaagaagctatttctaccacttgaaaaatttcctctctgcgcagacactgcttacagctttctggcatgtgacttaggaacaaagccatgattcttttaccggagaaggtttggggatatactttgaatgttaagttatttgggatgatgttttttgtcatttgatgccagctgccactgttcatgcagaattgagatatcagttaaactaaagcagatgcaaaatagatattatatctagactaagtatcatgcttagaatataaacacatatctacagtgcttttttataaagataaggctatgaatattttagtaatgtttggttttcctgatagaatttagatttgatctgcatagtgctaaaacctctttaagaacaccaccacatacttgggttttgtgattatttggatatgatcagggttaggttgtcctttccgtaaatgaagaacaggttgaagaaatcaattgtataaaaatgttataagtggagttctcagttgactccactttcctctagctctaaatttgtgatgatgtgatctttttgcaagcaccatttacatactgatgtacttgttacatttcattctaattagtcattaacatatgtcttctaaggacagttgaggaagcattctcttaccagaatttgttatgagttttttgctttttcttgtttctctttccccttctttcttcaaaatgacaagagagttttctttgcagtcatttgaaagtggctcagttgagttagagtgagctcattaattgtagatttgtggtaaccataactaatttttgaggaaggcatgacacagatgactgtatccaccagaaacaagtttcttattccctgattcaatcacccaggggattggttctgctggggcagggtgaagggaacagttttcagggtgtcaggtaaaaacagagacgctagtaacggtgtaaacacttgtttctccagggaaatatctggacctggctcaagacgggactcttgttcttgactttcctccttcctgtgtcttctcagattctcagcccagtgatgacgctgtcctcccactctgcattccctagatcacacacaaggctgtgaatgcttgtgtacctcatgtgctgggcatttccaagaaccagtggcttcctgtgaaagctgattcacaagtatgttttcagcttactgtgtgagcaattaaatccactgctgtcatccacagtaaaaactctccacatgctgcttcacagacctttttttccctttggctttaaacagagatgtttaatgaagatgagatttttatttccttttccatatataggagctactgaatgtaagggagaaagaacatggcttaatatggtgaaagtaatggaggcagtatataattatcattatctgctacaattaaggcagcatcacgctgtcttgtgacagtttattgtggtgtgtggggatgcagtaaagtgatatttatacccccatgactgccttgccattcagaaatccataactctataaatgcattctgtggctatagagcatatgtcttcagcacttccctattaggctgggtctttacattgagaatgtggcccatgaaatgagaataagctcatagaatagatcagaaagtaaaaagctgttcaacagcaatgatgaacaaaaccttcacctgtgcaataagggtgttgggatctattggtaaaaggcctggggcccgtctggtgataggccaggaccctgaggcagggctggataagatggagagggctgcattgcaccatgcattgcagaagaggcacactcatttcaagaaaggatacgggcttggctgagcgacacatgcaactaaaactcaagacacacattctaactttctctcaagctggagtcgggaggctggcatacaaagaggacaatgtaaggctagttatcacatgccaatgacggtggtgaagaaccacgtgttccatgagacgtggctgtctagaccatgttgtgcagaaaaaaacttgagtgagacatgggagctgaaatcagtgttctgagctggacaggacagaacctctaagacaaccaaggggcatttgagtgctggctttgccagagcaactagtgtgggcatcatcctgtttactgcctgttgcatggagacatgatggtacccactggatatggctgtggctaagtgtattattccgttcctacgctgctatgaagaaatacccagactgggtaatttataaagaaaagaggtttaattgactcacagttctgcatggctggagaggcctcaggaaacttatgatcatggcagaaggcacctcttcacagggtggcaggagagagaatgagtgtaggcagaggaaatgccagatgcttataaaaccatcagatctcgtgagaactcactcaatatcatgagaacagcgtggggaaaaccacccccatggttcaattacctccacctggtcctgcccttgacacagggggataattagaactcatggtgagatttgggtgggaacacggagccaaaccatatcactaaggttcgcttaactaatgtgtagaaagggttcagggcaatgtctataacatagctatcactcaatttaggttgctgttattattatcattttcatgatagagttattattattattccagaacagccaaagcctgcaccatctattccagcatatttcgagatttaaaagtacaccactatttcattctaaaggaatgacttgccaagatttaaatttcaagtactttgacacctaggggaatctccaccatgttggggctgcagggggtacaaggcccctcattgtacccttctggtgcctctccaccctgctcagtgccccaggaggctgactggcagaagctccattgccctttggtgtttgactgtgtttggccagtgggaggcactggaaggagttgcaggatggaagggaagtgaggccagagcgtttgcacccaactccctgcccacccattccctgaaccagagctagaacttccaccaggcagccttgccgttcggccacccttcccgggttgcagggcctgctctccttctgcatcttcctcaagcctagaagggggaatgccttcccaatgacaagccccaggtactgcactatccttgggtggtttccctaaatcttgcccatgccttcaaaaaaaaaaaaaaggggccctgtattaaactttccttcacttcccagtgtgagtgtgcttcctgcctcctgccgtgggtacttcctgttgtcctttaaatcacacctatataattgtttccatgacttcaaaactatttatagcatactttacctcatccctttctgttctcaccaactaaaatagcttatattttaacctttgtcatagagacacacaaatacacacctagtacctaaacaaagcagaggagaggcaagttaatcctctgtgcctacgaatatgttaatttttaaaagcattactgagatgcttagtaaagtagcaggtgttgtgaaattgcatttttattacccttccccatatcaggcaagaaagttatggtctcttcagctattttaccatttgctaaatgttcccagtcagttagcacagataatgcttttttttaaaatcatatttaggcaattagaaacttttgggttaattaattttgcatattagaagacaggactttaatataaatttaaggcaacgggtttaatattgtaaataataacagttatcacaaaccataaacatatttataatttatatgcatgaaaatagagtctgctgttaaaatattgaaaattaagataacacagctttcagcctcaaaatgaaaactttctgcatagctacactctctaagtaagacatatttggccaatgacttaatataaatgaatggcaattctttattcagacataccattattttctaatgcatgtagcatattcaaaagatgcatatgtttccaaaaattataccatcaaatgtgataagaaaggaagttatgatgaagggtaaataggagtgggagaacaaagaagccaggaattgggtttgaaagtaatgtccatgtcctgaaggcctctacaatgagctatgcatcctcccttttttatcatattcaatggtacaatttttggaaagatatgagggaaatgcaattggctaccctatgtttattatctagaagatgaaaataaccacctagtcaggtaatgcagatttcttcccagcaccaagataaagagatgtttactcattaatgagacactgtggcaacggaaggaaaaccaagctccacaggagcattcatctgatttcctaagactattttatttattgagctcctcaatgtagacagatggagtaacccaaacggcaatttagtggtagcaattctttggggggaaaaagctgagaatgttgcaatccaggtaaacatctcgatgatggctctaatgattgcagctgtcaattaactgatactcccacatttttgttgcaatggcagagaatatgaaagtcctaaggacaaaaacagcaaaccgtccttgagaatttacatgtggaagatgagagcctgagcctgtggggcctgactccaggctcccagaggcaacatgtggctccatttggacttcagaaaagcaggggaaaagaatgacgaggaggcacaaaagttattttaaaaccaggatgtagttgtaacaaatacagctggaaaagaggaaatgagatttttaaaatacaagaaaagatagcgaaaaagagcctctgttcccgttaatacctcctactgtgctaccaaagttcagggattgcaaatggctgtaatcatttggccaccgccatggactggcctgttagcagcaaagtcaggtctgatggcaggttccactctgacatctcagctccatattttagggttatttgcctctcaccttgaaaaacacctactgcagttaattattaactgtcaccttcacatcacccagagcgggctgatgttacagaacagcctcagccaactctcatctaaactctgggtttagttttctagtttttgttttgttttattttgtttcaggcatcatacctaaataatgcctaaacatctttctcctagtaggcagattattttttccttctaaatgtaattaaagatacaaactcaggctgtgtttgtgcttgccaagaaaagaacaagctagatttggtggccttcacagtattttttttagtattttaggtttctccattatctcaataaaagtccattttaatacattgaaatatttgaaatatatttataaaaattatgcgttaagtaatttagaactaaacaacaaatcggtaacatataatactatttaaagcaaatatcatcaagggtcaatttccttaatgcaaaaaaaatcatgcaaatcaatacgtgagaaaagaaatagaccaacagggaaaaatagataaatattatgagcagacagtttacaggaaaaatgatatataagaagatgcatatatcttaaaatatattggttgaataatatcctatcttaaacattttatttctacttaaaccatataaatgtatacttgctaaccgatcttttgacatagtttttcatgtttctcttattatataactctacccatcatgtattgccttttatttccaattttgatttcatcaaagcatagcaaaacataaaaaccttgtaagcactgacaatgatggtttccagctttacccatgtccctgcaaaggacatgaactcatccttttttatggctgcatagtattccatggtatatatgtaccacattttctttatccggtctatcattgatgggcattggggttggttccaagtctttgctgttgtgaacatgtatgccaggacttgtagtaaacaacaacaacaacaaaccttccaagtgcaaaatctctgtagatttttccttttttcccctcagtctttttttttaacagctttgctgaggtatagttttcatagcataaatttcactcattcaaaatgtataatcatccagcctgagcaattggttaagactcccatctctaaagaaatttaaatgaaaaaataaatacgacgtggaaatcaatgatttttttagtatgcttacagaattgtacacccatcgactgaatttaattttagaacatttttgtcactccaggaagaaaccttatgcatattagcagtcactccccacaccccttcctcctactccccagaccaagcagctgctgcttcctgtctgtgtagattttcatttccctattctgcacgtttcgtataaaaggaatcatgaactacgtggtctttcatgactggcttctttcatttaggatgaaatgttttcaaagttcatccacgttgtggcatgtatcagtactttattccctttagtggctgaataatcttccactgtatggatgtaccacattttgtttatccgttcattagtcagtggtcatttgggctacttaccctttttgactattgtaaataatgctgctctgaacatttgtgggtgtgcaagtgtttatctgggcatgtgttttcatttctcttgggtatatactcaggattgaaattgctgagtcaaatggtaactccatgtctaacattttgaggaacgccagactgtgtttcacaacaacttcaccattttaacagtcccaccggtaatgtatgggttcgaatttctccacatcctttgcatcacttgttattatctgacttttttattatagcaattttagtggttgtgaaatggcaactcattgtggctttgagttgatactcccttgtagaaaaacaagagtcaaacttacgttttaaaaaatatatgcttggggccgggcgtggtggctcacacttctaatcccagcactttgagaggctgaggcaggtggatcacctgaggtcatgagttcaagaccagactggccaacatggcaaaaccccgtctctactaaaaataccaaaaattagctgggcatggtggtgggcgcctctaatcccagctactcaggaggctgaggcagggacaattgcttgaacccaggaggcagaagtggcagtgagccaagattgcaccactacactccagcctgggcaacagagcaagactctgtctcaaaaaataataataatacacacacacacacacacacacacacacacacacacacacacacacacacgtgcttggggaacttttaacagggaaaatataatgtatgtgttatgtaggcttcagccacagatacatgatgaagcttacaactgtaaacatgcaggctttactcttcttgattactgagatggatggcagtttatcgacacttattcaggtttttgctcctttctgtcaatttaaatctcaggatcagtgaaaagagcccagggagaagacaggagatctgtgtgtccccagccctgtccccaaactgtctgtaagaactttcagcctctgaaactcatcagcagtagaagataacttgtctccaatatttgacagtggtgatgtgaaggtaaagcaaactgattaacacgaatcaactatgaaaaacttaaagcgatttaccagcatcttacatgtagtaaatgtattttacacacacacatatctattatattatatatacaggaccgaaagaataaagaaaaacattttttgggtaggaaaatggcagagacgacagcaatagcagtattttctggcaaaatgttacagaataagatggagtatacagaaaagtaaggttactcattcaaaacaacaaccacagatattttttgttgatattgttaggtttgggatttattttttagattttaatgaagatggtaggttaattgataaccttcttggcaggagaccataatcttggctttcagaatgtgaataaaaggggctctagtttctttcccctttttgtaatatcgttgtcacctcataactacagcttggggttttagctacagtccaaatgacattttaattaataaaatttggccataattaaattacatataaaaatatatcacaagtacctcttatttaacttttacttctttgccaatatataaagtggtcaataagacttctattcaaaaatagtgtattttttaaattttattattactatatttaagttttagggtacatgtgcacaacgtgcacgtttgttacatatgtatacatgtgccatgtttgtgtgctgcaaccattaactcgtcatttagcattaggtatatctcctaatgctatccttcccccctccccccaccccacaacaggccccagagagtgatattccacttcctgtgtccatgtgttctcattctccatttcccacctatgagtgagaacatgtggtgtttagttttttgtccttgcgatagtttgctgagaatgatggtttccagcttcatccatgtccctataaaggacatgaacccatcattttttatggctgcatagtatttcatggtgtatatgtgccacattttcttaatccagtctatcattgttggacatttgggttggttccaagtctttgctgttgtgaatagtgccacaataaacatacgtgtgcatgtgtctttatagcagcatgatttacaatccttagggtatttacccagtaatgggatggctgggtcaaatggtatttctagttctagatccccgaggaatcgccacactgacttccacaatggttgaactagtttacagtcccaccaacagtgtaaaagtgttcctatttctctacatcctctccagcacctgttgtttcctgactttttaatgatcgccgttctacctagtgtgagatggtatctcattgtggttttgatttgcatttctctgatggccagtgatgatgagcattttttcatgtgttttttgtctgcataaatgtcttctcttgagaagtgtctgttcatatcctttgcccactttttgatggggttgtttttttcttgtaaatttgtttgagttcattgtagattctggatattcaccctttgtcagatgagtaggttgcaaaaattttctcccattctgtaggttgcctgttcgctctgatggtagtttcttttgctgtgcagaagctctttagtttaattagatcccatttgtcaattttggcttttgttgccattgcttttggtgttttagacatgaagtccttgcccatgcctatgtcttgaatggtattgcctaggtttccttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattggtcgatatctctgttttggtaccagtaccacgctgtttttgttactgtagccttgtagtatagtttgaagtcaggtagcgtgatgcctccagctttgttcttttggcttacgattgacttggcaatgcgggctcttttttggttccatatgaacattaaggtagctttttccaattctgtgaagaaagtaattggtagcttgagggggatggcattgaatctataaattaccttgggcagtatggccattttcacgatattgattcttcctacccatgagcgtggaatgttcttccatttgttcatatcctcttttatttcattgagtagtggtttgtagttctccttgaagaggtccttcatatcccttgtaaattggattcctaagtattttattctctttgaagcaattgtgaatgggagttcactcatgatttggccctctgtttgtctgttattggtgtataagaatgcttgtgatatttgcacattgattttgtatcctgagactttgctgaagttgcttatcagcttaaggagattttgggctgagacaatggggttttctagatatacaatcatgtcatttgcaaacagggacaatttgacttcctcttttcctaattgaataccctttatttccttctcctgcctgattgccctggccagaacttccaacactatgttgaataggagtggtgagagagggcatccctgtcttgtgccggttttcaaagggaatgcttccagtttttgtccattcagtatgatattggctgtgggtttgacatagatagctcttattattttgagatacgtcccatcaatacctaatttattgcgaatttttagcatgaagggttgttgaattttatcaaaggccttttatgcatctattgagataatcatgtggtttttgtctttggttctgtttatatgctggattacgtttattgattttcgtatgttgaaccagccttgcatcccagggatgaagccgacttgatcatggtggataagctttttgatgtgctgctggattcagtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagctcctccttgtacctctggtagaatttggctgtgaatccatctggtcatggactttttttggttggtaagctattaattattgcctcaatttcagagcctgttattggtctattcagagattcaaattcttcctggtttagtcttgggagggtgtatgtgtctaggaatttatccatttcttctagattttctagtttatttgcgtagaggtgtttatggtattctctgatggtagtttgtatttctgtgggatcggtggtgatataacctttgtcattttttattgcatctatttgattcttctctcttttcttctttattagtcttgctagcagtctatcaattttgttgatcttttaaaaaaaccagctcctggattcattgattttttgaagggttttgtgtgtctctatttccttcagttctgctctgatcttagttatttcttaccttctgctagcttttgaatgtgtatgctcttgcttctctagttcttttaattgtgatgttagggtgtcaattttagatctttcctgctttctcttgtgggcatttagtgctataaatttccctctacacactgctttgaatgtgtcccagagattctagtatgttttgtctttgttctcgttggtttcaaagaacatctttatttctgctttcatttcgttatgtacccagtagtcattcaggagcaggttgttcagtttccatgtagttgagtgattttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagagctgagttcaattcctggatatccttgttaactttctgtctcattgatctgtctaatgttgacagtggggtgttaaagtctcccattattattgtgtgggagtctaagtctctttgtaggtcactaaggacttgctttattaatctgggtgctcctgtattgggtgcatatgtatttaggatagttagctcttcttgttgaattaatcccctcaccattatgtaatggccttgtttgtctcttttgatctttgttggtttaaagtctgctttatcagagactaagattgcaacccctgcctttttttgttttccatttgcttggtagatcttcctccatccctttatttggagcctatgtgtgtctctgcacatgagatgggtttcctgaatacagcacactgatgggtcttgactctattcaatttgctagtctgtgtcttttaatcggagcatttagcccatttacatttaaggttaatattgttatatgtgaatttgatcctgtcattatgatgttagctggtgattttgctcattagttgatgcagtttcttcctagccttgatggtctttacaatttggcatgtttttgcagtggctggtactggttgttcctttccatttttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccctattctcttctggcttgtagagtttctgctgagagatcaactgttagtctgatgggcttccctttgtgggtaaccctacctttctctctggctgcccttaacattttttccttcatttcaactttggtgaatctgacaattatgtgtcttggagttgctcttctcgaggagcatctttgtggtgttctctgtacttcctgaatctgaatgttggcctgccttgctagattggggaagttctcctggataatatcctgcagagcattttccaacttgattccattctccctgtcactttcaggtacaccaatcagatgtagatttggtcttttcacatagtcccatatttcttggaggacttgtttgtttctttttattcttttttctctaaacttctcttctcgcttcatttcattcattttgtcttccatcgctgatactctttcttgcagttgatcgaatcagctactgaggcttctgcattcatcacataattctcgtgctgtggttttcagctccatcaggtcctttaaggacttctctgcattagttattctagttagccattcatctaatttttcccaaggtttttaacttctttgccattggttcaaacttcctcctttagctcagagtagtttgatcttctgaagccttcttctctcaacttgtcaaagtcattctccatccagctctgttccgttgctggtgaggtgctgcgttcctttggaggaggagaggctctctgatttttagagtttctggtttttctgctctgttttttgcccatctttgtggttttatctacctttagtctttgatgatggtgacgtacagatgggtttttggtgtggatgtcctttctgtttgttagttttcgttctaacagacaggaccctcagctgcaggtctgttggagtttgctagaggtccactccagaccttgtttgcttgggtatcagcagcagtggctgcagaacagcagatattggtgaacctcaaatgctgctgcctgatcattcctctggaagttttgtctcagaggagtacccggccgtgtgaggtgtcagtctgcccctcctaggggatgcctcccagttaggctattcgggggtcaggaacccacgtgaggaggcagtctgcccattctcagatcccaagctgcgtgctgggagaaccactactctctttcaaagctgtcagacagcgacatttaagtctgcagaggttactgttgccttttgtttgtctgtgccctgcccccagaggtggagcctgtagaggcaggcaggcctccttgagctgtggtgggctccacgcagtttgagcttcccggctgctttgtttacctactcaagccttggcaatggtgggcgcccctcccccagcctcactgccaccttgcagtttgatctcagactgctgtgctagtaatgagcgaggctccgtgggcataggaccctccgagccaagtgcgggatataatctcctggtgtatggtttgttaagcccgtttggaaaagcgcagtattagggtgggagtgacccaattttccaggtgccgtctgtcacccctttctttgactaggaaagggagttccctgaccccttgcacttcctgggtgaggcgatgccttgccctgcttcggcttacgcacagtgcgctgcacccactgtcctgcacccactgtctggcactccccagtgagatgaacccagtacctcagttggaaatgcagaaatcacccaccttctgcgtcgctcacgctgggagctatagactggagctcttcctattcggccatcttggctccaccccaaaaatagtgtattttagacagtttagagagtcattattccatggttcagtatgaaccttctttttgctactgtttgtaccttttcgtcactgtgacttcatcaggaacaagaatttcatccctgcagcaaacaccgctgcgaatatggactgcagggtgacaaaatcatcgtcacaatttttacgctttctgaatttctcttgcaaatatccacattaacagtactaatattcttcagccttcaaaactcatgctgttttatttctcacacttgcccttcattctctttgtaatggatccacaatcgttccatctgtaatgttttgccttaaaagagcagtttttttcccaagtgtcttcaagaaccatttgtattagcatcaactgggtacatgtacagaatgcaaattcataggcctgaagctagacctgctggatcagggtatggcctggtaatgtgtattttcataagcatccaggtacctcacaggtgcacttatatcttgtatatactgctatggaaggtgctctgctctaattaatcaaacaagtatgtaatagagtaagcctcatagcataataaataatactgtgggccatggcagtaagaactggctcatttaaatactgttaaattatcaggacaagtattaaatatgtaatttttattaaatataccactggttgccagaagaattctcattgatgtagcagttttcacatttatatatatttataattttaaaatgatagataacatatactgaatgcttactattagccatgccctgtttttcataaattaatccatgtatataagtattttacatttactcatttatacagcatgatgagcgacaaggtgctatcattattatcattatcatcttagatggggaaactgaggcatgggggccccacagcactaagtggcagagccatgattcagcagtaaataatccagtaccaaagctctggtccttagcaattatacctgtactgtctctctatttgtaaagaaagtgtaggtctttaaatgctattttgaacagatttccatatacctatgtatagaataaccaactacaattgaacttttattgtaccttatcatactctacagctagatggctgtctttagtccattttgcactgctacaaagaaatacctgaagctgggcaatttataaggaaaagagttttattgggctcacagtgcccaggctgtacaagtagcatggagccagcatctgcttctggtgaggcctcaggctgcttccactcatggtgaaaggtggagggaagctggtgtgtggcaatcacgtggtgaggaagaacacaaagcagagggggaggtgccaggctctttttaacaaccggctcccatgggaatcatgtgtgagaactcactcactgccccccaccaaggagggcatcaatcttttcaccaggcatctgccctcatgacacaaacacctctcattaagccccacctccaacactggagatcaaattgcaacatgagatttggaggggccaaaacaaaccaaaagatagcaatgtctctggcatttaaacaatatatttaaactatatttggccacttaaaactacgtttgaggcctacctaatttaaaacgaatgaaaatagacaataattctacccttataatgcctaaaatctagttgcggagatttaaaaaaaattctaaccgttccataaataaacataactttgcaactttggcaaataatacaaaatagaattacacagaattgtgagagcttttaaaagatggtttattctcgacaggaaagtctggaggggcttccttgtgaacaggtgaatggatgaacagtcattaacctggtaaagcagggaccagtgatggggagctctgccttcggaaatggaagactgctgttacagaacaaatccgctatcaggaacatccagaaaaggtcaaaggcactgcagagctgccaaggaagtgaggacttgtgtcttcatgtccaaaagatggaagaacagagaggtagagaaatataggggtggcattcactcatttgcacaaggcagctgacaggttgtggatttctatagacttggggtctaaaagtagaagtcctgagaaacacactagagtttgaattggaatccccaaaggctacacactagaaaaaaagaattagagatggaattttcctcaggacgaaagcccagactgtaaagatgttaacccttgtctaaattaagaatatttgccttcttcctaactacctgccagaagcaaaagtgaatccactctggaggaagacaaagcatctagagcttcaaattatctgcacacctagtattggaaatatgaagtattgagccaaaaattaccaagaaagaacaaaataattgaacaaagagcaacagcaacacataagcgcgcgtgcgcacatgcacacacacacacacacacacacacacagacacacacaccagaataacagaagaaccagaaagaacttattagatatggactttagcatgtttgtaaaactaaatcataaaatacagagttattattatttatttatttttgagagggagtcttgctctgtggcccaggctggagtgcagtggtaggatctcagcttgctgcaacctccacctgccgggttcaagcgattctcctgtctcagcctcccaagtagctgggattgcaggtgtgtgccactgtgcccagctaatttttgtatttttagtaaagacagcatttcactgcgttggccaggcttgtctcaaactgctgacctcaagtgatccacccacctaggcctcccagagtgctgggattacaggtgtgagccactgtgtctggcccaaaatgtagaattataccatgaaatggaaaccatttaaaatcaaatgggcatattagaatggaaacaaaataagatatgaaattaagaactcaatgaatggatttaacaaccatttaacacagctgaacagaagaaaagggagcaaacaaaaaaattcaatatctggttacaagtagaaaaatgtagaaaacagtgtaacatgcataatagatgttggaaacctctagtataggtgtaattaaagttgcagaaggagaagacggagagaatagaaagggaactgttacagatgagatcatttcaaaagtaacggaaaaatccaacagatattagctgctgtatgaacttcagatagattacaacaaacagacaaaatgtacctaaggatatcataataaaatttctgaaaactgaagacaagaggaagtctaaaaagcagtcagagacaaaacatatgttatctttaaggggaaatagaaatactaataatgactgtataagagtgcaagtcagaagatggagacatgacattgtcaagtgcggaatgaaaataaatgccaaaatagaactccatatgctctaaagttcttcttcaaaacaaaggaaaaatataaggacatttttttgaaaaacaaaaacctaggaaatttgtcaaacttccagtaaaggaatgactgagagaactcttcatgcaaaaaaacataatcacagatgaaaatagatgacttaagaagagaagaatggaaaagataaatgtgtggctatgtccaagggaatattgattgtacaaaacaatgattagaaaaaaatacctatataaatcttgataaataatagcacaaaagacaggactttgttaaataatatttgattactcaaagttccttattacctggagaattgtagatatattaattaatgcaactatcaactaattgaaattaatatgattatcaatataagattctaattaagaatatattttgaatttatggggtaaacactgaaagaataataattgtttaataacaggctaatttgaagaagatttatcaataaacataattaactcaaaagaggaaaaacgggacaaacagaattagtaagattgattggaatgccaatgtgtcagtgattgcattaatgcaaatggattgaatactcagattaaaaggcaaaattgtcagactgaattagcaaataaagacaggcagctcacaaaaaaagctgcctaaaatatgaggaccaaaaaaaaaaaaaaaccctgaaaaaaagagagtaagttgaatacatgcaagcagtaggcaaaataaaattggcatatataattttgcaaatgacactgaaaggcaagaaatgacacatttctaaatataaatagtgtcattgcattaggattaaagggtctatctgacaagaatttataatcttagactggtatgcacctaataatatagcttcaaaatatataaagcaaaaattaacagaattaaggaggaaaatagacaaatctacaatcttagattttaccatacctctctgagaaactgaaagaacatccaagaaaaaaaatcaataaggatgtagtagatttgaaaatcacaatgagctaacttgatctagttgaaaaatacagaaatactacatctgtcatttcagaatatacatcatattctatccaatatgtatatgcattgcccaaattgaccgtatgtttgaaaacaaatcacacacacacacacacacacacagtatcaccaagtatagggattgaaattctgagtattttttctctaactatagtgagattaagctaaaagttaatattaaaaatatacctcaaacatctttaaatatttgtaaattatttctaaacaactcattggccaaaaataaaaattacaaaggaaattaaaagtgccaattttataacctaacatctcaataatttacccaatagaacagcaaataacacacagtcacacattgcttaatgacaggatactttatgaacccaacattcagtgatgttagtcattgtgtaaacatcaaagagtgtacttacatgaatatagagggtacagcctcctacacacttagcctatatggcatagctcctatactacaaacctgtacagcatgttgctggactgaatacctaattttactgtaccttttctatgtttagatatgccatggtaagtagttgtatatctaaacatagaaaaggtaaagtaaaattatggcataagaaataaataatgttacatctgtacagggaacttaccataaatggagcttctgtaacttagagttgctctgagtgagtctgggagtgagtggtgagtgaatgtgaaggtctaggacattactgtacactactgtagactttcccaacactttacacttaggctatactaaatttgtaaaaacaaaaactaaaactaaaacaaaaaaaacccttttcttttttcaataatatgttaacgttagcctactgtaacttttttactttctaacattttgagtttttaaaaaattatttgattcttttgcaatcacacttaccttaagacacaaataatacaatcatacagatattttctttatattcttatctatatgcttttatctattttcaaatttcttatttcatttgttactttttaaactttttgctaaaaattaagacacacacacaattttgtgtttattattatcaaacattatgtaccatacataattgtatcgctatacttttaaacaagcggtagtgcaataggtttgttcacaccagcatcaccaaaaactcgtgagaactgcattgtgctatggtgttaggacaatgatgatgtcactaggaacaggaatttttcggcttcattataatctgggactactgtggtatatgtggtctgtcatatgttgactgaaatgttatgtcatgcatgattgcataaagaaagtaggaaaaaatagtacgtatgaccaatcttattaattaaattgataaaaagtgcatgacacaactcaaaaagctaaaagttgtttttcaagcaaataattaaataggtaaacaccagggaagattgaatttttaaaaatcaagtattaccctattccaaatgaaaaagaacatcattttaatggaaaccaaaaagaagaagtatttgcaatgcttattaactgacaaaggactcatatcctggatatattaaaaggtttgacaaataaagatattaaaagtcctggacactacaaatgacaaatgggcaaaaacattaacacgcacgtcacaaaagaaaatatccaaattactaagaaacatataaaagctttccttttcactgtcattagtttttgaggcaatgcaagatacccgtataccgtcatcagaaatgttactcaaaagtgaaataaaacaaaatataacctgacaatatcaaatggtaagaagaatgtgaagcaacaggtcactcacatcctacttgtgtgggagtaattttgtgcagcctctgtttatcaggttacacaaggctgaatacacacattctaataaatctactaaggctaaacatataccttctaataaatctatcaagtttctagatatatagccttcagaaattcttacatgtgtaaatcaagactgtaatgagaatggtcataacatcattatttatgttagtgcctatccaagcaaaaaaaaaaaatccaaattgactcaacaatagcatggattgattatgaaatgttcataccatggaatgccatgcagtgatggaagctgactacagctacatacaatatctccgagtctcccaagggagacagagtgaaagaagccattcacattgattccatttatatggagttcagaagtctccccagctaactagcgttagaagtcaggatagtgattttctcaggggagaaatgggattgtaactagaagaatgcaccaagaaatcttttgagacaccgcttatcttgtatgtcttcatctggttgtgattacatggatgtatgcactttgagataagttattaagttgtagacttatgacttaggcacttctctctaaatgtcgtacttcaacaagatgttttggtttgtttttacattaaaagacagaaggaagaggagagtatttaaggtaaagaaaatagcacgaaaaaatctctgtgcaggaattaagtgtgtaccaagattgaataaagccatgtgaatggagtacagaggtaaagaaataaagataaagagaggaggaggggagatgggaaaaaaggaaggaggaaaggagaaagaaaagacaacagaaaaagaaaaaaaatgaagctggaaaagtaagtaatggcggcccctctccaaggtccagaaacttggatacttccctaatagcagtgaacgccagagaaggggtttagctgtggagagtgtggtgatgtgatgagatttgtacttcagatatctctagatgaatgcactggagaagggaaaaaagtagatgtgagtggatgaaaaaagaatgaacagcagttgtccagcagagagaagtgttcgttacctgggtctgagtgttggtggtagggaagctgcaggaatgtataattgtgtggatgctgggggtagagggagagggagctatgcttaaaataccagcccaagcttttctaactccaaaatatcttttatttatttgtttctttctttctttctttttttattttgagatggagtctcgctgtgccacccaggctggagtgcagcagtgccatctcagctcactgcaacctctgcctcctaggttcaagcaattctcctgtctcagcctcccgagtagctgggactgcaggtgcacgccaccacagctggctaatttttgtattttaagtagaggcagggtttcaccacattggtcaggctggtcttgaactcctgacctcaggtgaaccacctgcgtcggccctcaaagtgctgggattacaggcatgagtcactgtgcctggtccaaaatatctcttaaaaagtcatttaaccacgtgtttctcttttctataactcgttgtaaacaatgaattcctatatttaatagtgatgtcctttttgtattctagtttaataacactatttcatgggttaattgttttaataggaatttcctagtcgatatagttttatttattacctcattggaggaagagttttatacatattttatagaggtgggcccaaaagtccccgctatgttggtagacacataataattaaattttaaaaagctatggccttctaaatttttctttcttttgaaataaatatatacagatttttgacttatttatcaacaattgtgccatcttataggaaaattaacaaggttcatttatgaatgtgtcacaaaactgcttttcttgaactgctgatgtttgaatattataattttatgccatctgtgatatgagcatttgttacatataagttctatcataagcaaactaaaatcactccctttgtttaaatgtgtttagtaagtctattgctttcagtttataagtgtttgaccattgctcttctataaaagactctacaagaactctaaaatatatactgtgcttcactgattctgtaaaatagatatgtaaagtaatttcacattgttcaaagatactaggaatcacatacacttaactgcttatattttccaatactttgcttagttacaaagtttctgtataaagatattctcatgtataaaagagcccaacaattgttttgtacttcttacacttccttaagatagtatttaataccaacaaaatactgcttgagtcaggaggccttaatcaatttgttagagtaggaaactgaagagttaaaatagttgtggtattggcctacaccgacatgtgacgtgagacatggctgtggatatgacatccaggctccatcctctgttcctcctcttggaaattcggtctgtagcctaacacatttgttaatgcacagagacaagtatgtggggagaaaagacacactgagctggatacctgtgtattttggttcatacctgagatgaacctgaaatacagtctattacctgaaatagaagaccaacgtgttgtaatgaatttagtctgaattatctcattcctgggaggttcctgttaaattgagcaagtgcgagatagagatgaacataaatcatttctttcactcttagtctactctggcaaagtgaaacattgccaaagataacagtcttttaattaattttggaggttggtttatgtatacccttggaatttcttggatacatgcttcattaataggccaatatgcctaggtttaaagaagatatttattttaaaatttaatatgtcgattcttagttgaaagtatagtggaagaggcagcagcataaatatcctctcatttattgcttcgtttgttcgagaaacatgaattgaacaacctactactcatcagtcagtgtgaaagtaggaggactcaaagaagaacatgcaggcataggccttcaagttgggatgcaaaggcagccgtgccaataagtaaatatgtgtgataagttgttagatgtgcaattctagctataagatgattgatttaatggccaacatagcccttgtaatataacattagcactgaggtgagattaaattccgtttccatctcttggttgcaaagggtcagtggggaaatgggtcatctgtgagcagggttgatattggacttaatagttttgcatggatgatctataaatggctcttctctaatccttactacctacccaaatgatatccttattattccaacccaaaattagtgcaggagcttcctagctgccttgcctgtccctgtctccctgctttggagggtggatttgattttaaagtatggatcatgctatatcaatgtctacctgggggccttggctgcgacattcctgtttttgtaggacacggctcacatggctctcactgctggtctccacatgtccttccaccctcatttccatcacccagctctgcttccaggtgatagtgtactgaactactcaggccatccctctgcaggcattcattttccctggctccaggtcctaatggctaaatttgtattgctcctataaaatgtatttcagctgtcatcacttgctttagctttctttcatatttgcctaaagaccccaggagccctgccatctgtattcctgtatcatatttgtacaattatttttgttgttgtccatattgttaatttgcatatcacccaccagacaccgtgagatcctcaaggacagggactgttttctataataaaatctatcacatgtcatcaagcttggcatatcattagtctctcaacatattttaagttaatttgtctaatttctgaatgattgagagaagctaaaaacattggttatatgctttctccaaacgattattatcatacctgtgtgatttgtaaaataaatgccgacccatctcatactttttctagtagatatcttcctgaaaatttatgggtaaattaaatcatgtgaaatgaataatgtcttcagtgaaataggacagctcacattttaaagaacatcagtaatgaactaatctgtgtaaaagaatagttttagtctcttttcttatgtcacgttgactgtcgcttttacaaattgggaattttacaggttgagttgccttatgttggggttcctctaggtaaaggtattcatgcagttaaacttctagtaataagcaacaagaaaataacactgataaagtgacatgaggaatctgctcctgtgctgtaactatttcctgatgtcaaatgtgaaactgaacattttgccaaaagtctcaacttaaatcaaagccactttaatcaaagcagttgctaatgccagcagtacataaattgaggatggagcaaaaggatcgacaccaccaatggctgcattgtgataggtgtggacagagcctgccagaattaaacacatgccaggagtcaacactaggcaaaggtaaatgggataggtgctgtgaaacatggcagatcctatgggacttaggtgctcccaaacatggcagaccctatggggcttaggtgctgaaaaacacggcagattctatggggcttaggtgctgtgaaacatggcagcttctatgggatttaggtgctgtgaaacacggaagattccatggggcttaggtgctatggaacagggcagattctatgtgaccaaacctaacagaaacagtgcggtgagaatcgtaagataaacatgctattcctgtgatctgggtgaacaaacaaacaaaaacaggaaatacaactgcaaaacctagacagagaagagccaaaactgttgataaatataggaccaccttcgcatccccgtttgcgaaaatgttgataaatataggaccaccttcgcatccctgtttgtgaaactgttgataaatataggaccaccttcacatccctgtttgtgaatgcaatagcacaagaaaaagtcattttgaggatgggatagggaatgaacttctgatggtaatgctgtcttcaaatggttccgaattgaattttatcagaaatttaaatacccaaaattaatatagaaattgagaaccatcttatgttaagcactttttccttacacttactttccttcttttccttttttttgttctttttttttgagacagagtttcgctcttgttgcccaggccggagtgcaatggcacaatctcggctcaccacaacctccgcctcccgggttcaagcaattctgcctcagcctcctgagtagcttggattacaggtgtccaccaccatgcccagctaatttttgtaattttagtagagacgggattttaccatgttggccaggctggtcttgaactcctgacctcaggtggtccacccgcctcggcctcccaaagtgctgggattataggcgtgagccaccgcacctggacctgtctttcttacagagacctcttagcctcattcttttcctctccagtattccatatggcagtggctcaaggtagacacgttgcaaagaatgaacaggcattacctggatattcaggattgctttgctgttttattctgtgcagtgtttccttttatgcctgcttttcagccctatcctttctgcagggctctgggtcacaagctgggcaggaggagcagaacacagcgcctctaacaagtagcaggactggacgctgttggttaagtgttaggagaaaatgtgtctgctaatagggttatttgtttctttttttgggggaatttttattttttattttttatatataaactttaagttctagggtacatgtgcacaacgtgcaggtttgttacatatgtacacatgtgccatgttggtgtactgcacccattaactcgtcatttacattaggtatatctcctaatgctatccctccccaattcccgcaccccacaacaggccccagtgtgtgatgttccccttcctgtgaccaagtgttctcattgttcagttcccacctatgagtgaaaacatgcgttgtttggttttttgtcctcgcaatagtttgctgagaatgatggtttccagcttcatccatgtccctacaaaggacatgaactcatcgttttttatggctgcatagtattccatggtgtatatgtgccacattttcttaatccagtctatcatgttggacatttgggttgtgggactgtaaactagttcaaccattgtggaagacagtatggcgattcctcagggatctagaactagaaataccatttgacccagccatcccattactgggtatatacccaaaggaatataaatcatgctgctataaagacacatgcacacatatgtttattgtggttgtttcttaacataaaggtttaatccgtatgattccacttctgatttccagggataatttgaaggaaactataaaaatagaaggttaaaaaatatgtttgtcggccgggcgcagtggctcacgcctgtaattccagcactttggggaggccgaggtgggcaggtcctctgaggtcaggagtttgggaccagcatgaccaatatggtgaaaccccgtctctattaaaaatacaaaaattagctgggcgtggtggtgggcacctgtagtcccagctacttgggaggctgaggcaggagaatcacttgaacctgggaggcggaggttgcagtgagccgagatcacgccactggactccagcctagtgacaaagcaagactccgtctcaaaacaaaaatatatatatatatatatatatatatatatatatgtttgtcttcttgatttttcctctcctccatcatgtggtgatgggatgggaaaaggcaggttgtggggagcagtttggaggcccatgcttggtgggaaagagagggaggaaaattctagatgaacgaatgccgcttcaaaggaagaagcaaaagaaccatattaaccctgcttacaatcggatttagattggtgatatattctgtccacactcaactgggtttatcctgacattcaacagtgtaagtgacctgtactctaagtgttcccttcttgagaaaaggtgtgattgagcagcctgctgttgtctgaatttttgtctctcccttttccagaattcatatgtgaaacctaaccccagggtgatggtgttaggggctgaggactttgggaggtgatgaggtgatgagggaggagccatcaccctgataaaagggaccccagagaggtgcctttcctcacaccatgtgatgcacactgagaaggcgccatctgtgaaccagaaatcagattctcaccacacaaagcatctgcttgcaccttggtcttggacttccagcctccagaactgtgagaaataaattcctgttgtttataacccacgcattttacactattttgttatcacagccagaagacagtaagacaaatcccaacagagaagagtgcttctagaacctaaagtgcacctaccactttctagcaaagcctgatccacattactttaaaagtgacttttcaagcattttgctttggtttacctatttcttccacttacctctctcaagcccaaatcattagtttacacttgtaaccaattgctcgtgcacatgtcctaatgtttttgaatatacatatattaatacataatgtatcattcgtgtttgcatgtgggcattgtggataacttacatgtaattacagttgcaattacttagaatcatctacttcttcatgagctcgaaagtgacctcttattcttttttacaaacggagatttttttgtgaatgtaaataatggaaaagcttcccaaacccctcccagactccagctcccgccatgcccttcccctcaggcgctggcacgcccttacacacacacacacacacacacacacacacacacacacacagcctgatgtgtctatcagctctgaatctggtttttcaagtggcttgggtgggtctgcatatgaatttgaccaacctctgcgcgcgctcctgggagcgcgcatctgtgtgtggtccagggagccaaccgcgtttgtgaatggatgattgatgggaacagcgcccaggggcagcaggtggagacgggaacccaggtcgcggtcactggtcaacccgcctcttggggtggaggttagagaaatgggcgctgggatttggccccggccagtgctggggttccagggtagggagagccgtgggcgccagactgggctgcgggaggtcttcggggtcagatcccgcaggcagccaagagcgagccaaagaaacaaagccgccgagggacgcggctggggcggaggcccggagggaagtggaggccgggaagccaggtgtgcggcggggagagcggcccctgccacccgcgctggtagccgggcgctgccattcactgcaaggtcctctgcgccctggaattgccgcggcggcggatgcagaggccaacccagagtgcaaccatggagacgcgacgtgtgtcccatagtaacctgttacaacattatttataagctgccatccctagccttcccccgcttcccctccgctccctcgccagacttgcgggcgacgggcacagccgcgtctggctcttcccggcctctcccttctctcgcgggcgcagccgatcaatagttaacacccggctgcggacggcggctccatccgcggcaatcaccgtagtgcttgtttgtggaagccgagcgtgcgtgcgccgcgcgcgcacccagtccagcgcggagtgggcgtctacccgaggaggggtgtctggggaggggctgccctcgttacccaaacagtttgcgctcgcttaaccttgatgcagctcgaggcttcccagtccagctcagttcagacagaaaacctggcgcgcgcgcgcgcacacacacacgcctcccctggcgtcgccgcccggccgggtccctgcccttagggaccagagcggcgaccgctgcaccccgcaccgcctgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctccctccctggctcctggctttttgtttaaagcaacacccaccctccatccaggctttttttctttctttctttattggtagcggccaaaaagagttgattgctattgggatccgctgagtaaagacacgggcaggggtgcgcggaggtgagaaaactgaagacctggaagatttttttttccttcaaaaacccgtttccatccagtcttcagccagtccagtctactttaatcctcaccaggacaatggattaagtttctcttccctggaccagaagtcgggttcggacttggggcaaaatgaaggaaaaggccatgatcaagaccgctaagatgcaggggaacgtgatggtgagtgccacggacagggcgcgcgctgggtcggggggacccaccgtgaggagcgatgctgggggaggtctgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggctttgtgttttgggcgcgggatgggaggaaggggctgcggggagccctcgctgaccgcgggtcggtccgagccccaagcagacccccagggctcttctggggaaacgcggggagaggtggtcacttcggccagggaagggccactgggccctggcgcccgcgccggcctcggtgctccgagtccccggaactcgagacctgttgggtctgcggagccttcggtgctctcggggcaggcgccagtcgctccgctccgttccagacgccgccgccgggcgggaccctgctccctggattggggacgctgactcccccaaaagcttgactgtgccggaggaggtcaggggcacttcgtcccccaggagggccgcgtgcctggaaacgcggctggtccgcggaaggctccgggcagctggccaggggacagttctgcacggataactttctaagtggaggacccggcgatccgcctccccagcgagcccacccgcctcgccgctccccgctgacccgcgcggcctgggcgcgcctgctctcgggctcacgttagtccggggcacggggccgaggggtcagggcgctggagtctctggcgaggacgagagagttgccatcttgttctgttgaaattgtttgtgtgccttcgtgtgtttattttaacccattaggtcatggtctgagaagaatcctctgacggtcccttattttaagttgctggctggcactttttttttttttttttttttttttggcgacagacaaggagatggggattgccttgctacttttgaaggttctgcagatttgcagatgctacttttgagggttccgtaagaattgaagaaattctttcaggggcaaggtccagagttgtttacagaagtgggttgggtccaagtgatgggggtgcagaggcacctttgcgggaacccaggcagtggtgcattttgagatctcgctttaagcaaaacaggcaataagtgaaaaattctacattaattgaacaaatacccagctggcttaaccacacccacggcagacacctgttgcctggcagagagaagcgccgtgggttcagaacttgactctggacggaggtgtgagtctctgggttcaagacacctcgcagggaagtaatcgccgcatggaggggcttactcttcaggaccctccccactcccgagacgacaagcccccatctaggggcggttcgcagtcctcggtccgtgggttctctgactgacctaattgcttgtttatgaaaatgcatctgcttccctcatttttcccactctttttcttttttagccattgtgttgttcagcataatttcttgcataaacaggatagaaacgtgtatggagtaatgctttttcattaaatgcccaaccacatccatcattcctaacttacgtgatgccatcatgtgctagggaaacctgtatatttagggctgaggctgaagttaaggattgaggttaattatactgataaggcaacattattgactcattacatcaatctaccgccaaataagtttctacttataacttgcatggcatgaaagagccaaatcttcatattacacctttattagaaaccttatggtctttgccctccccctaacccctctctgcgttttacttcagaaaataaagaatgaaaggattgctaattacatttctctcttctgctctgaataaggatattccatgtgatactcattgcatcccttcccctgtgtctaatgttaagaagtgtcatcggagcaaggtgaacctgagcctagagaattctacagcaacccatattttcagagttatttgtgggcccaagaaaacaatgagatgcacacttactcaaactttgaatgttcttatcaattcttgaattgataattatggctccacagcctgctgtgtaacttatttgaattttcatgttccaaggaaatccacgtggcttcagttgagtgatcatttaggacttacccatgcctaatctctcaagttgctttggaagactcttgctaatcacagcctctcttggattagatgactggcaaattctttgcactcacaacttgattgaaattcaggtgatattttacattcaagatgaggactgaatgatttactcctattactgacagctgagctgccgcacatctgacagctacaaaaagtggcagaatgttttctactttgcagtaacagtgaacccacatacacacagagaccagatctcagttcaggggactcaaagatctctgagctgtctggactcgcatttgaggtttgatatttaaaaaagagaaagacactttgcactgcccaaatggtcacggaaatgtcaaatccagttcagccatgcctgtaaactgctttctaatccagcccctgctcgctgacatccacattgtatgattgttctggacctgcagcctgttgtttcaccgggagttctacaagaatggtgacaatagcctcccggctggtccttgccatgccacattgcttagttgaaagtatgttcttataaaatctttaaaaaatgttttattcctcacatattgctttaggaatttatttctgagtacagctagaggattaagagaaggcagatgcaccagcatactatctgatcttgttttgttttagtaaatgggtaaaagaaataccacaggtggaatcagtttagaacttttttttttttttttttttttttttggagacagagtctcactctgtcacccaggctggagtgcagtgcagtagcgcaatctcagttcactcctcccccagggttcaagccattctcctgcctcagcctctcgagtagctggggactacaggcgtgcaccaccatgcctggcttttttttttttttgcatttttagtagagacggggtttcatcatgttggccaggctggtcttgaacccctgacctcaggtaatctgcctgtctcggcctcccaaagtgctgggattacaggtgtgagccaccatgactggccagtttagaacttctattttaatttttttttttttttttttttgagatggagtctcactctgtcacccaggctggagtgcagtggtgctatctcggctcactgcaagctccgcctcccgggttcatgccattctcctgcctcagcctccccagtagctaggactacaggcgcccaccaccatgcccggctaatttttttgtatttttcgtagagacggggtttcgccatgttagccaggatggtctcgatctcttgacctcatgatccacccgcctcggcctcccaaagtgctgggattacaggcgtgagccaccttgcctggcccctagaacttctattttaattcttgagaagagtctatttcataaacttataatactgtgagaattcacagactaaccatgccatattcaatctgtaatttaatatactaagagataaatattttttacttgctcgaaacaaaaattatttttttaaaaatagctgttattttttccataaaatctacatttcagagttccaagggaggctgatgtgcactttttcaacctaatcttcctttattgctgtttggttgatattctgcttgtttaacagaggtatatactcttgcaataggttctgaggttaatgggaaatgtcatcagaagggtgttgcttcgtgctgaattcccctactctgtccatatgagcttttttcagacattgagttgcttaatgaagttggagtaaagattaaagactaaacatcttggggactgtcctgtgacccttggcgtctcccccttccttggtgtgtgcattggtggctccaccagtatgtggtgggtaagtgagggctgtgcaggcccatggtgactacagcagtatcagaggaggttcagacctaggacacaaagcatcagaggtctgcaagccatgttgatccttgagaatcccactgttgattgttgttggttttaaatgaaagtggctgtcttgagttccctgtatagggaaagctggagttcttccttgtgctcactgacactggttttaggcctttggtcactggttgatgtatctatggcatgacgagcctaggatcttttcagaactattgtcttctcttttctatgttggataaaacatctgaatgtgaactttccacagtaagagttctctttcgggcatttgaccgttttgctgattcagttaaataaagcagaatggcattccagcgatgatgctgtacttgtaattagcccaggtgagcagaggctcgttgaggtttttagataagtcatgagagctcgtgtgggacacaaagcttctattatttttttttttctgagatggagtctcactctgtctcccaggctggaatgcagtggcacagtctcagctcactgcagccttcacctcccaggttcaagcaatcctcttacctcagcctcccaagtagctaggattacaggcatgtgccaccacacccagttaatttttgtatttttagtagagacgaggttttgccacgttggtcaggctggtctcaaactcctgacgtcaggtggtctgcccgtctcggccccccaaagtgctgtgagccacctctccctgccaaatcttctattattgaagtctgtggggacagcatttctaggagtgtggccttcagtaatgcaatatttttcctctgtctgagggtacttggtatcagattggtcacttggtaacaaaatgcttggtgctggttctaaatgggagcagtgtagcacagattttgagggaatttgccttctcaaaatgggttccaaaaattctaaggtcacagttttctgagagttgtcaccatgtgtcccagtggtgtgatacttaggttggtctttctctgcttgctagttgttcaacatcccttcataaaatcatcacccttataactagacgtttcttgaaatattgattaatcccatctgtgcaggaaacagtagctaggcatgggtctgtttcataatcctccttgcaggatttataggaatggggatactttaaacatgtttatggcccattaaaaaatgcagatttccagaaagaagatcccaaagccagaggtgatcagcacaggatgttttataaaatttcttcaataaaactgtagtgaagagggctgtgctgttttttcacagagctctgtttagttctttagttcatatatccactgggtctgagtttttcaacatataaatgtactaaattggctcttccctgttgcacagccatcatctccttttctgtaacctgtcctggtcagtaatcacaatactgctaacttgatcatcatttggactttgaaccctctgtgctattaccaagaggtgtggtgcttattgaaatatgaacatctagtattcattcgtccccatggacaagggctttgcacaggaagcatttgagcggatgaattcgttaaatgaatggatatttgttccttgcttaggactgcttagcataggctgtgcatttgtgagaaaggctcatggttttagttgaacgtttaagaactccttcaagtcctaatacatcaggtaacaggagagagaattccctgcatagagtattttccactttcagctacaaatggaaacttaggctcagtttagattgtaaacagctgatgcatcaatcttctttatttgaggaggcgtagaagtcaaataaaatatagagagcaatctctcaacttaaaatgttttacttgggaagcaagaattgcaatctgaggcatacacagaccagtggtcttcagtatgtctgaagaacaaagacgagattgtggattttattaggaaaggaaatgttacttactgttttggaagaaaactcattggccctggagaagcttttgagagctggcaagctctgattggtgagttgactgtggtaggtaaagctagagtcactgcaggttgtttcagcagttactaggtaaaactggtcttagaggtacagcaggctgtttcagcagctgagcttgtgggaaatttaattcttggagcaggtgctatgtgtccccagtactttttccctggccccgcaactcacacattgagttgcttaatgaaaatggagtaaagactacagactaaacttcttggggactgccctgtgacccttggtttccaaggaccacaaggattttattgggtatgacaagaatgacccaatttgtataatcagcttttgcagaggtaaatacatttagtccagatcattttaaaattttctgtttattaaactaaaataaattcagcaacatagaagaattccatgacctcttttggttgtgggagccaattttatttgatagcaagaccacattttagaactcaagagcgtgcctcagatcttctaggtcccttgaacatactaagctcagaacagacaggcaggcagaaccaagcagaattccccctttaccattgtggcttcctgggatgatgggagaaagggttccattcgggaagtagaagtttcaaaaacccatcttggacagtggctcttggcaatggctgaacagtagaatcagctggaatgttttgaaaaacccagtcatctatgggtgttgtggagttgggaatgtttggttaagtgtagaggttctcaacattgcctggagccactggttcctcctgcccccgacctcttccccagtacccacccctggcctagagatacccaggggattctgattccactgcttcaaaatgcagtctgtgcactcatatgtttaatagtgcttctgttgtgcagccaagatgcagaaccagtggatcagaggcaaattttttgaataaatattgccatcaaagcctaaggaaataattataacatttataagggagcttcttgaaaaatatgcaatcaagtcttgttccctgggttgtggaggccgccaaatacatggaaagatgggcagagaacacagaataaggagaaaaatgaagtgaaacatgcatgagagagaaaagtaaatagtcaccagggaaaagatgaggaaacatgctgtgtttttaagttttctaacctcagttatagactgaatttggggaaaaacaagaatctttaaagaaattcaattgtcctcctttcctttttcttcacgcccagaaaaaattaatcttcttgactgaaagatactctattatgtgtctgaggtccccccgaaaagttattacaaacccaacagggcaagtagaaacaaggagggtgatagaagaaagctgaaggctgccctcgaccagcagaagttgttctgggatttgcaatggcctctgaggggcctctgcaggcagctccctggactgctgtttcctcatgtgtcgaataaggaaatttgaatagattgattattcttgaagtccctttcaactccctctcccagttaagggtagcctcattactgtctcctcaacattgctcttaggacatgctttagaagtcaccttccatgccagaacaaatattttgttggcatcatgatttcttctgcattgacttatgtggcatctctcagctcgccagtcttgtctcagcaagcatgccactgtatacggggaaaacaaatagatggcatcaatgtatagtcctattggacacaaaatctagagcattcatgcaccagccttgatgacccaggaagactgtatatgtgtgtgtgtagcacaccatatacatgcatgtgcatgcgtgcacacacacacacacacacacacacacacacacacaatgttcatacatctcagatgtaaaatactggcaccattgtccagcatagctgaagatctgttggataagagctcctgtgggtgcaatcactttgactgcttggctttcttggatattaaaaaaataaccacactgtaataaaacaggagtgccaaggatgttctggtttccagtgtggtgttactcgtctgtgaaaataaaagtgaattgctggctagccaggccggccacaaggcctgttttgcaaggcaccaattggatgggatgggactgcactgggtctcactacgagaggtctaaggctgagcacattttcttcactgatattggtatttgaaaagtgggattttcttctctttttccctctcctactggactaatgcccctattaagccacacatagttttattttaaataattctcattttatggtattggtcctatataaacaacttttagtaaaacctccactgacagaaactcaactacaaacttgagcaaactggactaacagtctcatacgtttcattacattaatctaaaaaatggtacttctagggtatgttctgacttcattatacattcagcttaatattctataccttcttgtcctatatttttgggaagtgagaattaataattttcaagcctaaaggccaaatttttttttcattcttataaaaattattttgattgtggactacattttctatgatgaggtaaaaatgaattaacacatgaacaatttatctttaacaggctgggcacagtggctcacacctgtaatctcagcactttgggaggctgaggtgggaggatcacttgaggccaggaatttgataccagcctgtgcaacatagacagcatctctacaaaaaaatttttaaaaataattatccagaagttgatattatattatgtggctgtcatcctagctactgaggaggctgaggcaggaggatcttttgagcccatgagattgaggctgccgtgggccaagattgtgccaatgcacttcagcctgggtggcaaagcaagaccccgtttctttaaaaagtaatacataaataaatatacttatttataacagaaaatcaaagattatcttgttaaatggtagttttctagaaaattgcatttatcagaccaaatcatatcttgagcaaactttttataagagggttctgttttgttatttttcttcctatgactctgtaaattgtgcatctatttttttaagatctccaccctttcatttcaaacttaattatattgataacttatagttgtagagaacttacacagcttccaaaataattttgtctgtgctatgttattatgttagaacaacccattgtgttggaaagacagatattagttctttttttatggttgaaagagctaagattttgagagagtatatagtggggctggttatttgaggaggagctgaggtgctgacccatttccagcccaggttctttgcacaccacaatgtattctttcagaaattatcttctttccagttgcaactgaaaagaaacatagtgcctggaagatgggggagaaaaataagagatcaagtgggagagtatgtcttctgctctatcctcataggatttctagcctctgctggaacacatccaaggactggaaacttgtgccattgttgacaagttctgtttgttaaaatggtatttcttaagttcggaagatacatatacatacctccattgaactttcacctacagttttagcttgaagccttttaactacaaaaattttcttatccctacttcacatgacaacctttcaagtaagttccaacagttgccatgtgaccccttcatagtctcttttctagggaaaatgtctctatttctttcaacttatatatgaaagtttgatcagggtaactgtgaatttaacaacaagacaccatattttttattcaatcattgccatcgttatctgtttcttagcttccacaaatttcttcctatttattgttgttgatttgatagtcttcatactgttttccacagtggctgtactaatttaattcccaccagcagtgcacaagtgttcccctttctccacatcctcaccaataaatgctacttgtttttgagccattagtgaactgatagaaaacagcattctggaccgaaaaagtagattgtctccaaaagctgtgtggataaggagcaatgaaagaaagataataccaaggcaaatacctggaggatgtgaagccaagagcatcagaggagaaaaggaaccatcaagaggttggttagtgggtacaaacagacagatagaaggaataagttctcatgttcaatagcacagtagggtgactgcaattactaataatttattgtatatttcaaaacagctaaaagagtctgggtgcagtggctcacacctgtaatctcagcactttgggaggtcgaggtgggagaattacttgagtctaggagtttaagaccagcctgggccacacaacaagacgccatctctaaaaaaaatttaaaatatgccaggcttggtggcatccacctgtagtcccagctacttgggaggcttaggtgcaaggattgcttgaggccaggagttcaaggttaaagtgagctgtgatggtgccacggcactccagcctgggtgacagagtgagaccttgtctgtaaaaaaataataataattagaagagaagatttgaaatgttcccaacgtgaaaaaatgatcactgtttgaggtgatgaatatcctaagtaaacatacatcaaaatatcacatgtacctcataaatatgtataattattatgtatcaacaagaaaatgaaaacgagaatgttgaaacaggtggaaagatattcatatagagcctttgggaaatgctagtcactggacatgggaggaaaatggccgtcttcagttgcggtatcagaggccttccacaataagcagtgttaattggcaaacaggggctatgagaaacacacaagtgatgaaaaccagccttatttctactggaatctcaggtcttacctgacttaccaccatctaagtttgcatagtcacctctaaaagtgtgagcatcttttctgtgctttgctggtttgtatataacttttattcagatatctttcactctaataagtagttctttgcattctgattagttggctttatgaaataagtcaccattattcaagaagggaaaggcgagagacaaaggcattcggcttccattagtgtttggaattacagccacacacaaattaagggtgaatgaaaacaaatgccctcctgtagctgctgctggtattcctccccacctcctcttcactctctctcctcctcctcctttttctccttctcttatttatcctcctcctcttcttccttctcctcttcctcttccttctcctcctcctcctcctccttctcctcctcctcctttgattatcttaagccagatgtgtattcttacccaggtttgtgatatgtctacccttgcctttatgttgggaaacgtgaggaagctgagcccagctcccaggacagtttggtcgcctctaatcataccatccagccataatctcaggctgaaggaaatcattcattggcactaaagagagctggggagatagctgacagaggaatgcaatggatcgtctcgctcatccaccttttgccatttgtttgattttttcctgcaatgtgttttcttctcgtcaacttggccggaatggtggtaaatgctgtttttatatgtggacttacttgaaaaactgatctatcttagtcttggactttgaatatcattaaagttctccaaggaccttgcaaatagctgcttgccaaacacaatagtttaatataatttgatctctcactgctgcttagcttctgagaaatgtgttgtgctcaaagtgttcaagcattaattaaaattgagagcactgaaattgtcagcgcccactgactccatgtgagtgtgtaggtgagtgtgaatgtgtgtgcacaggcaggtgcaggtgtgtactcacatgcgtattaacgcttaggaagctgaactttgcttctttctcattaagagttgaaggctattatctaatcatgaaaataaaaactctgatggaattaacttgatgttgactctcagtttgatttctgaagataaaccagagtcatctctactctgaaatattaacgtattctagagagtggttcccaacatgatgtgacgctggacctgcgttatcagcatcagctgggagctttagaagaacaaaatcttgagcccacccagacctactgaatcagaagctcagagggtgggtgattctgatctgcattaaaatttagttctaagtgtacccattcgcaaactctttgtggtgaagtgccagtgatttcatttttgtttttaaaatttcgtggctcagtactttctcccatctttctgttttttttttttttctgagccctacaaactttttcaacctctgccctaaagctgctttcagattttcaggtatctttgtagcaatgccccattccttggtatgtgttgctataaaggcatacctgaggctgggtaatctttaaggaaaagaggtttattttgctcacggttctgcaagctgtacaagaagcacaggcaccagcatctgcttctggtgaagtcctcaagctgtttccactcatggcagaaggtggaggggagccagtgtgtagaaatcacatggccatagagggaacaagagagagaggaaggaggtgccaagctctttttaacaatcagttacccagggaatgagtaacgggatgactaactcattatctcgagggtaacaccaagccattcatgaggcgtctgcctccatgacccaaatacctctcagtagattccacctccacctccaaccttggggatcaaatttgaacatgaggtttggggggtggataaacatccaaactatagcagcacccaaaagctgaaagtgccatgtcttattttttattttcagccttatccgtagcacgctttatggtagcaaagaggtctacaagctgtggccccaaaataatttaactttcttactgtaacctttccattttaaatttgattcactgtagagcatttccatgggtagaactgggtcaaagagaagtctttcattttagagttttgttattaaggaagaattgggtattttcatactttttaaagtttatttttggctatgattacttacagtggttcattttttatagacatctaggaaatgttaattactgcagataagattcccaattcagaagccaaccacaaaggcttttcttcttcttcttctatatatatataaaggagataatgctaaaatgctcttatgcaaattttaaaattccctagtacattaacaatgctaatgacagttaatgcattcctgaagcttctgtgtgatccaaaatattcaaaatgcttagaaatgttttaggtccaccctgcaaatatatgggaagtggaattttgttcatggaaattagttccttgaaaatagattcagtgccaagtttaagagatgaagaagagctgaaaagtcagtgtagtgcaatatagagtcttctgcggataaaggtcgaaaccctcttttcccagaccaccatagtgggtaggtacagaatctcagataatcactgcagtttggttagaagaggaaattgcccttcataaagcaacacagaagaaggtaaggagaaagtggtattagattgataggtcaactaatgataatgaagaaactttctcttgctgacggtgatgtcagcttctaccaggactaacttcagtgagcacaggaatggcattgctgttcaatagggttataccctcaggtgggatgacagaagacagaccctcgttgtttctttgctgacctagggaattctgcaaagcagaaatatgaagaatgaagatgctgactctttacagacagctttatttaggtgaattcaggttgttacatggtcttgccacaagtgcatcttattctagaagttgtctgactacttcaacatgcatttctttccttctttcttccttgagctccttaatattaaatgcaaatgaggggaggcgtgttgaagttacactaaggtttagttgtagcaaaaatgtgctttgtgcacctactggaaattcccttgtggaatctttatagtaaagcctattggggaaatataattgaaaacaaaatcttcttccaacctagaaatcctctccacaaaggtagtagagaaagagaacacttttcttatttgaataagcattaaaccagaatggtgatgcacatcacagacaagatgctaaaagatcacaaagacagaattctcttatatagccaggcagatgcaacccattaaatacatgttttcaagataaacagtagctcaccctgaagtaagaggatttgacagcatcatttgtcaaatagttcatcctaactttactagctgcttactggctttatttagaggggggaaaagcctctcatatcttcatgatagaaggtagttttgcatattagagcaaagtgtccaccgatgttaggctccagaaactgggagacaggggttctgtctcccttgatgtttgcattttaaaaagatggttccagatctttgggaacaagatccccgggtcataaagctaacaaaagccctccctatctagtcttcacaaggatgcacttccaagagatgaaaaagtgcttataggccgggcgtggtggctcacacctgtaatcccagcactttgggaggctgaggcgggtggatcacctgaggtcaggagttcgagaccagcctggccaacatggtgaaaccctgtctctactaaaaatacaaaaaattagctgggtgtggtggcaggtgcctgtaatcccagctgtttgggaggttgaggcaggagtatcgcttgaacctgggaaggggaggttgcagtgagccgagcttacaccattgcactccagcctgggtaacaagagtgaaaccccgtcaaaaaaaaaagtgcttataattacaagttttcttaggtaaagctctaagaaaaaggagaagaaaacactttcctcctgattttcaacaggaagaagtaagtgtcttatttctagcttgtattagtccttacaagccagagcattcaaatgagtaaccgctacaatagccagcaaagctacagacacccagtaagaggaactggagcctgtcccaggcttgcagatgctgagtgctcgagatgttgacacaatttagccaaaattgaggatcaggagactgccaaggacaccggtgcttgatggaactattccctcttccaagaatttaagagcaagaaaaaaactcagccatatacttggagcagtggctttcatattcaggactaggagcatttgggttctgcaggatgtgggatggaggcatggctaaggagcagccataggggtgatcggagtggccacaggggtgatcaggcctgaaaagcctgccactcagaagcctttcttccaagagttgtttattcactgcttagcaatgagatcagcactttgcctgctgcatctcacaaagccctctgacaaccctggatgaaggtactaatatctttagttttcaaatgaggctcaaagaagttcaatgagaaaactgcccagggtcacctaggtagtaggtagaaaattagtatcccacttagatgtgtgtcactgtgtcatctgaagagaagagattaagcattgggcttgctagacaacaaggatactcttcaacatataaacaatcttattcaataaaatcttattaatgccctgttgactgaggttgcattaagagcatgtggaagcttatccgatgtttccattctctggtctctacttgtgactttgctttttattttctcttctgtgctggaagtgctggaaagcacctcatcttttgtcttttcagttgttggatttaggttccatgattaagggttgtgttgctattgttttcagtactttgttctctttctgtatcccaggaagtcagcaactgggccctgtctcctacagaagcaggaagaggactgagggttgagggacttttggtggttttctaaaactgtcaatcatcctatgtgtgacaagcagagagtttcctgtatctctgttgcctaagcaaaggagcaggtgggaaagtattttgctaactagcgatctaagatgaggtttttgttgttgttgttgtcatttttgagatggactctcactgtgttgcctaagctggacggcagtggcatgatcttgactcactgcagcttccacctcccaagctcaagcaattctcctgcctcagcctcccaagtagctgggactacaggcacgcaccactatgcctggctaatttttgtattcttagtaaagacggggtttcactgtgttggccaggctggtctcgaactcctgagctcaagtgatatgcccgcctcagcctcccaaaatgctgggattacaggcgtgagtcaccacacctggccagttattctttgattctcctgcaccatctttcaattttttacacttggggcattttccctgttctcagcaccctcatcagtgtggaccaggacaacgggagagggtaaacctgaattcctccaactctaatgactttattaaaaggcttgagggggagggcagaaagggtatagtggtaacagtgagcactttgaatctcacttaccctaatcatttcttgaatgattgaaggagtaatgggaccctccttattccttactcctaaattctcactattgattgaacgtctcatacgcaggcactgagacacctcagtgaataaaatatagtcctcgccttccttcttggggcttccattctagtggcagaaatagacagtgattacacagctaattatttaattacaagtctgatgcattctgcaaaaacattgtaagggccaagggaaagcttctcctttgccttctgaaggttcactgaaaatcaactgatgaaagacaggtgaacaggagaagaggcttacaaatttgatcacagttttacacaggagctttcggaatgaagacgcaaagatagacaggaagctgtccatttttatgcttaggttcaacaaactgtggacagctgtgtggaaataggattggcacaaagggtctgatctaatgccaatacagtgagggggaaagcccagtaagatctgcccatctagattcttcttggcctctctgcagaattccttccttctgggcatggggcagcaccctctctgtaatgggaggtcttatgacccacagtcgaacaaggcaggtcaggtgatttcgttatggtcagtttttacacagaaaggtggggaaagttggagtagtagttttaggttttatggctggcttttgggaacagaggatctggttcgtatgattatgttgggagagaggatcctagtttctctggccagcctcgggagaaaatgaggggccagaaacagaagagcaggagggggagtggggagaaatgtttgcttctgaggccttcattttgggttatcattttctgggcctcagcaaaagcagattgagattattattatattaacataagcattgtggtctaggtttggatgtttctacaaggtgtttcgaagcgaatgactcagtgaaagatacaatgggtgagaaagatggttctctcacattgtcaatccaaggcagaataaaaaagtcataattaaaaatatttcttaaaggggataaaatgagtatgtattggcaatttgctactacagtgaggtgtttaaaaagagaaaaaaaattaaatgaaatgtaaaatgaaacctgggtatctataacttgtgaaggctgaggaatagaagatacttcactgagaaaaggcagaggactcccttgactaggtgtaaggatgtgctcttgagatgctgggaacaaggaagtccgtgggagcaatggggaggaccaacacacgagcagcatctgctttgaaaagtggagactgaattgcggtttgatcctgggagcaaacaccaaagaacttagagctaataatagcgaagccataggaagagcagcaacagagaagcttgggtggaaggacttcgaatacataaaagttggaacaaaataaaccaaggagacaaacggaagtgttacacaggtatttttctttataagagaaatatattttaagagcactaaagggcctttgagctcagcttttatgaagaaatctgtttcaagatagaagagatatattgtaggtttctgttaaattaatggcaaataccactagctaagacaaagctagtgcttaagagctaagcattctttattttaattagtttattcttatggatttaggggtacaagtgcagttgtgttacgcggatatagtgtgtggtggtgaagtctgggctttttgtgtgctcatcgctcatagactgtacattgtacccactgggtagtatgtgacaccccacactcctcccaccctccaatctttggaatctacagtgtctattattgcactctatacgttgctgtgtatccattgtttaactcccagttataagtgaggatgtgtggcttttaagtttttaatttctgagttagggtctcactctgtctcccaggctggggtgcacttgcatgatcttggctcgctgcagcctcggcctcccaggctcaggtaatcctcccacctcagcctcctgagtagctgggaccacaggcacatcttaccatgtctagttaatttttgtatttttttgtagagacagggtttctccatgttgcccaggctggtctcaaactctcagactcaagcaatccacccgcttcaggcagctagggtgtgaggattacaggcgtgagccattgctcccaaccccagtttttaactttttgttgtcgagcaatttcactaaggataatagcctccatttctacccctcctggaaaagacaagttttcattctttcatatggccgagtagtattccatcgtgtatacgtaccacattttaaaaatccagtcatccattaatagacgcttagattgcttctgtgactttgctgttgtgaatagtgctgcaataaacatgtaagtcagatgtctttttgataaaataagttattttcctttgcatagatacccagtagtgttattggtagatcaaagtgtagttccatttttagttctttgagaaatttccatactgtttcccatagaggttgtattaatttacatttctaccaatagtatataaccattcccttttctctgcatccttgccaacatctgttgtttttttgactttcaaataatggctttctgagtgctgtaagatggtatctcattgtggctttaatttgcacttctctgatgatgagtgatgatgagcattttttcctgtgtttgttggccaagagctaagcattctgatggcttcgtgtggatcaaatcacagctggattgttcagttttggatgccaaatataaagagggacagacaaactggcattcatccagaagagaggaatcaggatcacgagagattagaagttgtattggtaaagggaatttgaataaatgatattatctaatctaggtgtgatagctaaatttatgtgtccacttggctgggctgcagtgcccaggtacgttgtgagacatcattctggatatttccatgagggtgttttggatgagatgaacatttaaatcagtggactttgagtaaagcagattgccttccctggtgcagtgggccttgtccaatcagttggaggtctggatagaacaagaggctgacctccccagagtaatggggaattctgcagcaaatggcctctggacttgaactgcagcattgacttttctctgggtttccagcctgctggtctgtccacattttggacttgccagctcctataatcacatgagctcattccttagtataaatctttctatatacgtatgtgtacgtcctattccttctgtttctcctgggaacgctgactgatacactaggaaagcagagatgtgggatggaggcatggtaagtgtttttagatatctggagggcttttatggaaatagacacagatttgttttctatgaatttgagagacccagatccctggattgaaatttagaggctggaagttttttttttttttttttttgcttaattgaaagaagacaacaagaattgatacattgatacaattcttttttagctgattgtgagtcagcaaaattcaaaacattgagttctttatagcttccgtgcatcaccacttgtgcaaggtactgtagaatggattcaatgtgcctgttgggaattagaattataaagaattttggaagtttctagtctgtcattgtttctggtaatgcatgctgtgaagggctaagaaatgtgttcatcccacagaggatgaaacaacagacttggtcaaaaaagtatagttatggtccttttaaatggaaaaattcagaccacagctggataggaacaaaatcctgaaaacagtgacagattcagtgtctggttattttaatactactcatgtgtagacatggatagaaaaatgcagatagtagagtaccaaaaaatacctattggaagtataaaaagaatggtaattaaatgatttctataggcacacagtctgataagagagagacctcattttatgtagctcttttactgaaaatgtggcatttatttttctgtattaattcaatgtatttcaaatgaactaaaaacctgccatcttcaaggatttcattatacgattccttatgaacactgtcataaaatgagtagttaactcatttaattttttgtgaatgaaaatatgaatggtcacatgttgaatttatttttatttttttacttttttgagacagagtcttgctctgtcgcccaggctggagtcagtggtgcaatcttggctcactgcaacctccgcctcccagattcaagcgattctcctgcctcagcctcctgagtacctgggactacaggcacgtgccaccatgccgggctaatttttgtatttttagtagagatggggtttcactatattggccaggccggtctcgaactcctaacctcatgatctgcccgcctcagccttccaaagtgctgggattacaggcatgagccactgtgctcagccctaaatttactttaaaagggttatacatgtgttggtaaatagcatcaagaaatacattccttctatgttatcgttattttaattctttatttttgtccccaaaagatttacttacagatcttggatgatcttgggtcttgaatgggcatgctgaggttctacctctgggcaggaagataggtgtgaagcaacctctaacagcttgtgcggaaaattacccccaggttagcaccagtgaggcacagttgttcagcagagcaggggctgggcattgttgtagagcagagccacgcccttccattccagagcacttggagcagttggtgtttatgctgctgggttgtttttattgaggacaaacatgcttttacatttatctatcttaaaaaaaacttaaaaactcacaagacaacttccctgatatgccctgtccccctccagctaccagtctttcccttgaataactcaatactataatgccactatttttaactcctcctcatttcctcttaaaaatctcccatctgactttggttcttaccactgcatggaagaattacctgtccacatcgcaaacgacctccttcccactatattcagtggtcagttcccacttaagtctctgaaggagctcaggaaatgacaccccaaaatacaccgctttggacttcaaacttccccagtcacttggtgaacagcaaattctgagaggagctttctgagtaccttttacctaccagacggatcctccagaggggacacaattgtcatgaatcccctccctagaacttcatcaaccagggactgctggctgatatcacaggagaggatattggagctgacactgcacccagacaggttttgtctcaggctgtcttctgtcctgctaaggggccattcacccgccctagaaatcatttactctcccctaagttgcctacatccaccctctctctcctatggagagggtatataagctttcggatgtctctgggtttcgagtattcatttttctttcatgtgatgctccgtgaatgtaatacacatgtatactttttctcttgttaatctgtcttaagtcaatttaatttgtagcccagccaaggaacttccaagagtggaaggaggccattttcacccttccagggcctggcagcacttttttgaccactttctttctttctttttttttttttgagatggagtctcgctctgtcacacaggctggagtgcagtggtgcaatctcggctcactgcaacctctgcctcctgcgttcaagcacttctcctgcctcagacccctgagtagctgggactataggcacgagcccacacccagataattttgaccactttctttattgagcttccaggtcacccttccctccatctcaggggctgcttatttccttttcctggctgcctctccagcccagggctcaagcatcattcttctgccttttcctagatggcctcattcatctacatagctttaagcagaatctgtgttctgaagacttctaaatttgcatgtcagcctctgagctttaggcttttacaccaaatttcccccagacttcacctctcacgtgcctaatgggtcataaaaaccagcagagccaaaacagaactggatttacctcttccacccctttctccctgggcttcctgaccttggtgcacagaaccattgttcatcctaatattcaggctctgaagcttgcagcgacctttggtttcgttctcacttcatagctcacagccaatccccacatcaacaagcagctcgggtttcagatgcatcacatctgaccacgtctcccctccctcaggggtcccagttcagtcagtgccatcatcctctcctacctggactgcaagtggactcttacttggcttccctgcttccactttgggtcagagacacatcatgtgtcctcagagacaaattatgagtccagagtgatcgttttagacacgggtcagattacttcactcactagctctgcactctgctaggataaaaccatatttcttactgagacactggctggctgatgtagaggcctccagcctgacccctagccttgctggggtctcaggggcacattgagtcttattgagtcccagctcctttgcacctgcttctccttccctgaaaccgtcttcacccagatgttggcttgctctttgcagagtgctcttcctgtagaccttcatgctcaaatcgttgtccacactctgtgccccttccccagtatcatgatccctgctcagtcactcgctgtccacaccctttcctttcactgagatcatagtgtatgtttattggttggcatgactattatctgtctccacagctaggatgtaggcttcactctcagggatcttgtcttgtcttgttcactttttgtatccctagtagatgctctcccaaatttagatggaatgaattaatgtgggggaggagttgttcagaatgtgatttaatacataaaaaacttttggctccccactcccttcctctctcagtttgcaatggaaagtgattgcaaagtaaagatagtacagattggtaatttggtaatcactgtgtcagtgtggctcacagtggcaacattatcacatgcagattaataaattgaggtcaacagaaactgcttctgcatgcagagaatataggaggacagagaggacagagatacatatagtgttatattactatcaccaattcagttacaatgctgttaggttttgtcacctatttttaaataattgtcctgttacatctttttctttttgcggaaggcaccagtttagcatagtttgtgcaatggctgtccattaaaatcttagtaaggtgataatccaaatcagatgctgtatagcctatgctggtttaagtcctgaagtacttatctgaaaacttcgggttaaattaggaattcagaacttttcagaattcaagaagctaacacaaattgtctttattatgtattaggtaacatccccagtggtgtctgaggcaccatcccacaaacccattgtaatttctgccaaaaaaaaatatgtacactaagtagaatcaataaatttaccagtggcttcatatcagttcctgtaatttttgccactgaagaagttcagagaagaaaagattttgtctccaaatgagtttttaaggagctttattggatgaaattactgaaacattgaaacatatacacactcaaataaaacgaactggaaccgtcgcaaaggatgcagaggaggtggcctgacatcagctgagaggggaggtcagagagaacccagggagcgagagcttcatgaaagagatgcagctggagttgcactttagttgaaggactcctctgcaaaaagctgaatcctccccagcctggatccaaattctctttcctattacatttcagctgccaaaatagctctttgaatttggtgcttagaaggatttagagatactaaaaattgcagcatttcctacagagctatttgtaagaggaaagcaatggaggtagagaagtgggttgttgagaataatagggtgaacttgaaagaggaaaagatgaggattaaaataggggcaatcttcctcatgttgaaatttctgaaattcagtattctctaaggagttgcactctaatttttcttaagggggagaaaatgaaagttttcaaatcatacacgtgcacagacacacacacctatgttttgcagggaggaatagctgagctgttagagccccacacagcaggtaatctctttggcctcctcattaacactctaatcagcccttttgcagccattctaacttaagaaaaatagtaaacctctgaaatagccttaaaaaagatgagtgtaaaccacttcagtctagcttttgaacatggtgtctattgaaaaccctattatgttagctggtaaccaacgatggaggtttcttctccagtagtaactgtgtgtaaaggtttttatgcttaggactgtgtttaggagttgtgatacattttatttagttttgagatggaatctcactctgtcgcccagactggagtgcggtggcacgatctcaactcactgcaacctctgcctcccaggttcaagcaattctcatgcctcagcctcctaagtagccgggattacaggcaagcaccaccatgctcagctaatttttgtacttttagtagagacagggtatcaccatgtcagccagcaggtctcaaactcctgacctcaagtcatcacccaccatgacctcccaaagtgctgggattacaggcgtgagccactgcacccggccaacatatcaattatttggtttgagctagcttacaataaaatcactcttacaacagagattcattgtttcttcatgtttctgtaagctgcatttaagtatcataaagtctaaaaattggataaaaatatgatgactgaccttaatttctacctccctgggacttggttctagagctgtagtttggaccagcactaagtctgtcttaccttttttcccctgataaatattcagtatttgaggaaatcatcacatctccctttagcattcttttggcaaggtaaaagactactgaatccagttttggggaccattgttaaactttgctttttcagaccttagaaacatgttaaagtcttgcaaaggagcccttggcataactgtgtgactagatatgctccaaagctctagaacatgatgatgttccatgtacgtctccatctgagtaagggggggaagagggcttggctggtgctggatgggtctcattcaatgcaatgccaaactcttaacatttgaaaattatatagtagaaatacggactttcttatgaatgccaagaaactgcttgcttctcctattgtctgaatagccagagagaatacttgcacttactattcactgaaaactgacttatttggtgataacggtttggctgtatccccacccaaatctcatcttgaattgtagctcccataattcccacgtgttgtgggagggacctggcaggaggtaattgaatcatgggggtgggtctttcccatgctgttctcgtcatactgaataagtcccacaaggtctgatgattttataagggcagagtttccctgcacaagttctgtcttccctgccaccatggaagacgtgccttttgccttctgccatgattgtgagccctccccagccatgtggaactgtgagttcataaaacctctttttctgtataattaccccagtcttaaatatgtctttttcagtagcatgagaacagactaatacatatggctaagtcagatcctaagtccaggaattccccagttctccataccttccctggagctgtatgtttataagaattttctcttcagtaggagcccttttaaattgcagaagtgctttcttctgaccacagccctatctttgagggaatagctttattgagttattgtttgcatagcatatttaagagtacagttcaataaattttagcatatttagagttgtgctaccatcaccacaatctaattttataacattcactgcatttggaaaggaaacttcatctcatctcatgagtttattttgaatgtggatcttcttggaaaagtaactgattcctcttctttacagataaagacatcagcgttcggagagattgagactgcctttgttctttattccacagggcccagagtgcatcacccaagaaagctctctgaccatgcatggtcaagtataaaacagtgtacgaatgttaaactagtgttagatgatttttgtctatgctgtggggctcacctctcccatctctcccagtctcatccataactgggtctgaactcttgcttttatttattatttaaaatttcaaactatcttgtccttgtctagctaaaattgctaatgccctttttaagctttccttaaagggatttaattgttcagcagtagaatcttttctgctgtacgtgtgatttctcttggaggaagtgaattctttcttataagtgagtgtcaaggggaaagcacagaacatcaggcttaaagcttgagttgtggccctatgatttcagttccatatacagaaatccatccgcccaacaaagaaccttctaaacattctacagacttgtccaaagtgactctactgtgtagcagagcagagaaaccaagtttgtgacccattttctggcatcctaaaggatatctaagaacctagtgatgacacccccagtccctagctcctacccccatgccaagctgtctcccactcattgcctctggatcatggtgcaacttgccactccaagaagatccacatgcaaataagctcatgaaatggaacgaggtttcctagggccatgtcctactcacatttgaatgaccatagttttagcaagatcatctttttaagaatagtttgcttctttctaacaccgaagtgaaattggtagaaacagagagaatcaggatcagaattaaagagacgagatagctctggaggcctttgaggacagtcactcccatgtgaagtgaaaacaaaccaagggtagcagtggcccctaccactgggggcagagatgctggttgctagaatggcaccaggggtacagaaagtcaccttctgctcctgtgacttgcttatcccatgctgcatgggtgtgaaaggttctgatgctactctttgtatttttggtagagagacaatgaatcagcatttcaagctacaggcaaaataaataatatgtttagacatgtcttaaaggattaatacttcagaatctgagaaagcaaagttagtaaacccaacctgggccagtggtggacacactaagataaatagctcctctgatttttatttatttatttatttatttatttatttatttattttcgagacagagtctcgctctgtcgcccaggctggagtgcagtggcgcgatctctgctcactgcaagctctgcctcccaggttcacgccattctcctgcctcagcctcccgagtagctgggactacaggcgcccgccactgcgcctggctaatgtttttttttttgtatttttagtagagatggggtttcaccatgttagccaggatagtctcgatctcctgacctcttgatcctcccaccttggcctcacaaagtgctgggattacaggcgtgagccactgtgcccggccctctgatttttaaataacatgttcttggagaaagtggggcctgaacagtcagtcacattttcttcccctatctccccttccctcctgtcccctcctatctcctcccctctcctcccctcccctctcctcccctcctctctcctcccctcccctcccctcttcgaagtctatctctgtcacccagactggagtgcagtggcacgatctcggctcactgcaacctctgcctcccaggttcaagcaattctgcctcagcctcccgagtaggtaggattacaggtgcccaccatcacgcccagctaatttttgtatttttagtagaaacggggtttcactgtgttggctaggctggtctcgaactcctgacctcatgatctgcccgcctcggcctcccaaagtgctgggattacaagcgtgagctactgcacccggccttcttttttatttttacatatccttaaggactaggaaacatttgggtcacactggtgcttacattcaaacctataaacaggaattaatgtatttctttgccatttattttataaattttattactctgtgtgtgtattttaaagaagaatttctggtgagttttctattcttatttgtatctattacttacctcaatggcttgttccaacatgattgttgtgtgtaaaagtaatttgtgaatagagcatcgctgattagtgttgtcacaattgagcgagtgtgtcccagagctttgcttttcacactcgcacactcatatggatcatctgaaaatcttgtgaaaatgtagattccattcagtgggtctggggtgggacctgggattctgcatttctaacaaactccagagagatgtggatgctgcatctgtgagctgtgctttaagtagcaagttcttatagggtctacagtgtgatgaaccagacagggccaagcaatgcaggtttccccagagatgagcacttcctgcccctcagtctgtagggattaggacacagtgcctatcacagttggcttgtgggaatatattctgggagcagaggcctgcttggagaacaaatgtcctctttgctacgtttttccagcatttaaattgatccagtatgggactgtacagatagcaagaaatgcagatgaacttgggcagtgttaaaacctggatatcctccatgaagcagattgggtctggcccatgctggtggcagtttacctcctcccgctgttccctcttccctggccactgagggtttataaacttgtgaaggcgtggagactctcaggaagttgctgccacatttctctctcttacagacgctaagattccctttcagtaattgaaagtggtctgaaggctctggaaagacagaaatgaaggaccttctttaaaaacaaacgtttacagcaccttctcgaagattcaaatttcgtggattatatgtggttattctagtgtgacatgcgaagggtggataggtacctgtttttaaaaggtatttttgttttgacatttcgtatttccattatttcaaattgcatcagactgaagtcctagcaaaagtatacattacttttatctttccattcatgggaaaatgaaagaaaatgtttcagagacttttctaaaaagatttgatctcctcagtgttaatatccttagctacccaattcagaaaattacagatttccttataattggtttacttgattatttaggatgttttctgtcatcctgggggatgtagaatgtgtgtctgatacagtgattgttagttttaaacaaataagaacatgctatatgtgacacatgcacacctcgtgagctgaactggtactttaactaccacatggcacatttattcccaaagctattgggtcagataccattttctggaaataaccgagtcataaatgatggcgtcttattggtctctacaacatgaccctaggacactttgactgctgtgaaactggcacttaaaatagagtgaaatataattgaaaattgcacattgaagatttcttattcattccttattattagctgcagaaatcatgtgtttatagacctttttcagttggatatcttttgctattttaaaatgattgaatacgttagtcagtttgactatttctgccaaggcaaaaagaagagttaattaaaacacacacacacacacacacacacacacacacacacacactctctctctctctctctctctctttttctgccaaggcaaaaagaagaggtaattaaaacacacacacacacacacacacacacacacacacacacacagtctctctctctctctctctctctctctctctctctctctctctctctctctctgtctctctcactactggtgatatcatctctgtgtagccaagcagaccactacagatcattgcttttcttagaaattacagccgggcatggtggctcaagcctgtaatcccagcactttgagaggcccacctgggcagatcacttgaggccaggagttcaggatcaacctggccaacatggtgaaaccccgtctctactaaaatacaaaaattagctgggcatggtggtgcatgcctgtaattccagctacttgggaggctgaggcatgagaattgcttgaacctgggaggcagaggttgcagtgagccgagatcatgccactgcactccagtctgggtgacagagcaagactctgtctcaaaaaaaaaaaaaaaaaaagaaaatttgagtaataaaatcagaactatcctgtgtgcctcggtacagtggagtaagaatgtctgttcctcatgctgtaccccattcaaaacagttgaatgcatggcttgagaatgggttgtaaaccacagctggatttccttggccttattcttgaactgtttgtaattggtgagaaagcagtgagcccagcagatggagaatttgctacctgaggacactcggtgtcatccaggtgctaggtgatctgactctatgtcatccttgcaccagtggaagattgggttatgcctttcccctagcaaactctcatgcagcctcctggggcaccagtgcattcatcgtccgaatgcctggctggggacaagaccagagggcctgaaggaaagctggttccaggaggaacccaggctcattcttggcctcatgcatgtgagtccttaaacaccagtttgcacatattcagtgctacactaaactctacctctgcctaagttgaatggttgtctactttgatgaaaaaaaatgtgtttaatagaggacttcctcatgtaggaaagcagaaatggtaatttacagaggataagaaaaagtacacgttaatccaagaaatacaaactcaggtggatgaactgcagaggccaggagtcagggggaaataagaattagccccaataggtctgttttataagcacagagaacaacatgcatgtaatattgtgtcaaatacttctaaaaaatgaaagcttcggcctctgtttcatgaatttctccgttaaattattcagtctgatttatgagctactgtttaatgtattttagattggggaaatcaaataggagtggggtggatgtaattgtatttattacaaatgtgagttgcttgttcattgagattattataaagttggccagagaatggattgacttttcaggtcctagacacacctgcccaggaagtaacgtcactaatagtaatagtacctggaggtagcatgagcttattgatttagttttacttctgcctgaggccaaaatgtcctgcagtagtaatgattcaaatgtacctcatggaaatcaagtgaggtaatgcaaagaacatgaaatccacatacttgctgctgttgacagaaaactgttccatgccaggcaggatctagccaacaggctgttgtagattgctgataattagcttccctgaaagtcgagggggtgacctgcagacatgtcactgggttaataatttctgtttttgtttttataacttcccttgaagcaaagttctttcctgtgtccgggtcttcccagaattggctgagagaaccgacaagcaactggcttgctatccaaagtgctaaagaatcttttgcgatgctgtgtggcaacaatgttgcaatcattaatagaactgatctaaaaggaagaaagagagaaagacaagaggcctcaaagcagcgagaaaggttgctggaggtactgttccagaatgggttgtagaactcccagctggtggacccttcacttacttcctgtgtaggtagtcaacctttttcttttatctctctctttttttttttttttttgagatggagtctcactctgtcccaggctggagtgcagtggcgggatctcggctcactgcaacctccgcctcctgggttcaagctgttctcctaccttagcctcctgagtagctgggattacaaacgtgtgccaccatgcctggctaatttttgtatttttagcagagatggggtttcaccatgttggccaggctggtctcgaactcctgacctcatgatctgcccacctcagcctcccaaagtgctgggattacaggcgtgagccaccgcgcctggccctttcttacacgttattaatattaatacaaatgtgtcaccaatttcactatcatcatgcaccaaataagtcacttcctagattaaaatactaagtctcagaaggcttaaataagggcatctacccacacgatcctgaagttctgtgggaggttgtatttatctttcacaattattgaattccttgctctatagcgagaagatctggccacatgactttccctggccaatgatatgtaggagaaagcgagtgttaggagccacttgtggctgtgtctctctttttctgctgttagatcagcatgtattttaggtacaggctgtgctgtcagcctggatcccagagggaagaagacacagagcagggtacccttggtggatgctcggcaagagccgggagcaagcctctcctcctcaggcctctagggttctggaattgattgttatcacagcataactcagcccagcctgactgataacagacatcttaagtattaggatcttcagtttatatttatttaaaatgatgttatcttgtcacattgttccaaaaactattaaatgctgcttacaaaatacatccaattcagtggaattaaaatgaataaagcacataactcataacatttttgagtaaaagaaaatgagggtagagaaatcaatcaaggccaaggctgacaccgtttgatccagtaaagtgtgtgacgtgtctgcccaaggccagccacagtgccactgtaaagagggaacacattgttcacagcctaaatatacctgactgttttcatctccagcaagctctgcacacagtgagtaatagcagagtgagaattaaagtgtgctactttatcagtagctgaacaggtacataatggccctttaaataaaatgctggattaggacacatcacttaggtctccagacttagtagagtgtcttaccttccgctgtttcttctcaacccccaagtctaaattttgattcaagcaaacttgaaagtatctgcaaggcgagaaagttagctgggtctgaggagcaggctctggccaagctgacacacccagctgtgcattttggagagtgctgcaaagcaaagtctcaccagggcctgcctctctgcctactgcatgggaacaggaagcctatcagagccgacggctttgcacgtcaggcccagcaacccaagggcactattgatctggttcaaccgatacggtcctgagtgggagtctagaggtaaggacacggtgtgtagagtcagtgatgatgactcgatggcaaggtagaaacacttcccacgctcatacaaactgtaaacccaagtgggtgtacttttctttgtttaaaataaaaagaataattggctgggtgaggtggctgatgcctgtaatcctagcactttgggaggctgaggcaggcagattgcttgagtccaggagtctgagaccaggctgggcaacatagtgagaccccgtctctataaaaaattcagattagctgggcatagtggcatgcttttgtattcccagctgcttgggaggctaaggtaggaggatcacctgagcctgggaggtcaaggctgcagtgagccgtggtagcaccactgtactccagcctgggtgacagagtgagaccttgtctctaaaaacaagatgaagcaaaatgataatctcagccacctgtcaccagcttaactgcatttctccaggtctgagaaacaaattctatacatatttttatgtctctgatatcattgtatatcttataaataatggtataccatattttaattgggagtaatttttctttataaagtggtccataaaacagtgttacatattacaatcaataatctcttagatttgatgaaatgtggtaaaagaacatttaccatggcaaaaataccaccttgcatcaggagagaaagggttctatcctgaatagcccacgctgggtttaaggagaggccttagcgagcccccagcactctgacgtgtctgacatccagtctttggacaacaatcaaaaaagggacatccaaagctggcccatttcagaaaaggcaacgcagacacctgcagtccctgacatcagtgattccaaatgggttgggactctttgatcatttttaataaacccaaagtttgcagctcaaaatggccagagccacgtagtgagtgatttgcagaagcaaatgcaatgcttggaccttcaatccccagaaagcaaggatggaatggtgaaaccagctgccgccaaacagccaggcagtgggcgtcctagcgggaaagaggaatagaaggatttgagattaagcaggcactgaacacctaggagaccatccttagaatcccagtctctttatgttgaaaattattgcctgttagaaagacctgtttcctaaggcaaagggcaaggtgaacataacatccatggcattaagatgcctaatgccaggtttattatggtatgtgtatgtgcacgtattttctatcctgcatgctaagtatttgaagtggaacttgcagacaaccatgtggagtgatggattaaatttcccctttcttaggaagttcagaagtccaaggaggcagtgttcatgaatagaaggttccttcatcttggcccggcgtggtggctcatgcctgtagtcccagcactttgggaggccaaggcgggcagatcatgaggtcaggagatcgagaccatcctggctaatatggtgaaacctcgtctctactaaaaatacaaaaaattagccgggcatggtggcgggcacctgtagtcccagctacttgggaggctgaggcagaagaatggcgtgaacccaggaggcacagcttgcagtgagctgagatcgtgccactgcactccagcctgggcaacagagcgagactccatctcaaaaaaaaaaaaaaaaaaaaaagaagattccttcatcttagcggggaggatctgaaggagtcaccctggttacatctttgtatctcaccctcacaatgctcatttagtcatcggtggatccctttaaatatcaagtatgggatacaaaaggataatactagaaaataaatactaactcagccatgctatggtttaaatatcaccaggcacacaagactcaagaactgcttttcaaatccatgaacatacgtgtctacagtcattttctagctgggtaaccctgagctggttatgcagtctctctgttagtttccttatatgtgtaacataaaataacagtaatgtgtattattgaggatttttttttttttttcgagacggagtcttgctctgtcaccaggctggagtgcaatggcgcgatccctgtgatctccgcctcctgagttcaagcgattctcctgcctcagcctcccgagtagctgggattataggcacatgtcaccacgctcaactaattttttgtattttagtagagacgaggtttcaccattttggccaggatggtctcgatctcctgaccttgtgatctgcctgcctcagcctccccaaagtgctgggattacaggcgtgagccactgtgcccggcctcattgagggttttgaggaggtttaaatgaattgatattggtgtttgatgatgatgacaatgatgatgaaagttgttattaaaccatcgctccctccctgtggccagccttcccaccttctgggagatcttattcaatcttttaactctccccttttctagagctttccttctgctttctggatcacagcactgggaatgtggatctgcttttagatcagtgctttgagaagtaggagaacaactgtggtcgtggcggttggtctttgatgccagtaagcaacagaccatctgccttgttgttgatctgagtcattgatggccagattgaaagagcagagggttcctgagtcccaggtgttgcaggacgttgtgtgtgcccacaagccaggctacatggcttagagcagcagcccaagtgctccgttggttcagggggtagcaggggtccatggagaagtcagagtcctgactgccagtgtttggaggcatggtttctgtaagcttgttgcgcagcagtcaagaaagatctggactcgaggacattggtgtcagtgtcacctacctagctacacttggtctggttgttgacattgtacttcagggctgtgggtcttccagggccaggtcagaagcctgctgatcgacccaaagtgtggatgatggaagctgtggagcagggctgagggtgaggagagaaggagcccattaaccacaagctcagagtatactctgattccctaagaaggctggtccaggaccttctgagtcaagtctgaggttctgatgaagggagaccatccgcatagtagaaggtccccaagattctgatgaagggagactatctgcatggtggaaggtccccaaggttctgatgaagggagatcatcccgcatggtggagggtccccgaggttctgatgaagagagatcatcctgcatggttgagggtccctgcagttctgatgaagggagatcatcccgcatcgtggagggtccctgaggttctgatgaggggagatcatcctgcatggtggaaggtccccgaggttctgatgaagggatatcctgcatgatcgagggtccctgtggttctgatgaggggagatcatcctgcatggtggagggtccccgaggttctgatgaggggagaccactccatatggtggagggtctctgcagttctgataatgggagatcatcctgcatggtagaaggtccctgaggttctgataaagggagatcatcccacatggtggagggtccctgaggttctgatgaagggagatcatcccacatggtagagggtccccaaggtttggatgaacggagatcatcccacatggtggaaggtccagcctggcagtgtgacccaaagtggcttccctaatctttctgagcctctgtttctacaaactctaaagtgcccactcaccaggggtaactgttgatttttactttggctccacaatgtgagtgtctggtatatttccagttacatcgtaggaactcctgtgatggcatgaggagggtgagggtgatggcatcccttgatgattcctgccgaccacagcaggtacctgcagtccctgtagttcctcagggacactcctcacacccgttagggaacagttcaccacagcatccttccacgtcctctctccaggtgaactcagagatctgttcattcaacaagaattgatggggcacctgagtcattcttctaaggtagttgacattcccagtcctgattcatggttgttccatccttatctcatctgttacctgtcaccgatcatgtacacctttctatctttgagtctgttttgcacatatatacaagtaaatcacatcgaagtttaaattgtctcattaatttgtgaaatgtgattacaaaattcttgaaatcacatttctatcctattaggaaagcaaaaaggagaaaacaattttgaagcctaactcctaagagaattgctgtattacaaggagacagggatgctgtgaattcgttacaggaaagaggatgtcagccctcatgcctttgtctcccaagggcctggactttcctccacttgatttgtagagagtgcttttggaagatgggtgtgttttatttagatggtacaggtgtcagaaggtaagaggtgtgatggaagttgataggtgactgttacttgaaggaagggggaatgaagtctaaaaggttagctacacattttatctccctgatctccctatgatgcaaagaacccaagaatgtgtctttgtaacaaaaactggttgttacatggacagtgatcagagaaatcacttgccgattagaatttctccctatgtagcattccatgaaataaacagacagctgctcctggttcccccagaaaaatacagatttgtaaaaaaaagaaaaaaaaaaatactacttgttaccaaaatgttttctgagtatattcttttatcttacagaaaacatctacgtattttaaattattgttgtggaaaatgtatacacacacctacacattcattgtaagaaattccaaagtaaaagtttacctgaaattctgtcatgctgatatttattttttaagttaaatttttttttttttttactgaaagtaataattggctgggcatggtgacttatgcctgtaatcactttggaagacgaaggcaggaggattgcttgaggccaggagtttgagaccaatctgggcaacagagttagaccgtgtctctaaaaaatattgacaagttggctgggcgtggtgctgtactcctgtagctctaactactcagaaggctgaggtgggaggatcacttgagtgccggagttcgagtctgcagtgagctgtggtcgtgccactgcactctagcctgggcgacagagcaagacccattctctaaaatcaatgagtaaataaatcataaaaataaaaataattgtagatatctgtggggtacaatgtgatgttgtgatacatgtatactttgtaaaatgtgatatatcagctttaatattttggtggacaccctttaattcatctctgttacaatatacatatactgtatggaattgtgtgtgtcataaatgaaaccatggcttctacttcagtgatatccattgtaacatctactgggaaggttggatgcccagaagatatggccaactaaattactcagtgtatgaacaagaagcacatcatgtcgtcttaaaagtgattgtgttcttatacatttttattgtggatgagttagaaaatatggagaagatagaaaaggtgctaagagtataatccaaccaccctaggaagactttgtcttagtccctcagggctgctattaaaatgccatggatcttctggatagctaaacgatgggggctcctggagggtggggctttcaggtaaggcatggataccttgccctacccatctcttcctttggtgttcatcagtatcctttgtagtatcctttattaaaaacagtaaacatcagtgcacacttaaaagcatgataattgccaaaagaatagcttctgaagaccatgggttcagaggtctgaaacttggaaatcactcaagggaccctccgcctctctttctcttgcgctgtctcccagatgctgccacaaccagttgaatggtataacattaacaataacaattaattaaataaaagatatcatacactgggtagcttaaaaacagcagaaatttatttctcacagttctggaagctggaagtccaagatcaaggtgccaatagatttggtgtctactgagggccagttttcttttctttttttcttttttttttttgagatggagtttcatgctgctgcccaggctggagttcagtggcacgatcttggctcactgcaacctccgtctcccaagttcaagtgattctcctgccttagcctcccaagtagctgggattacaggcgtgcaccaccatacctggctaatttttttcttttctttcatttttttttttttttttttttttttggtagagacagagtttcaccatgttggccaggctggtcttgaactcccaacctcaggtgatctgcccacctcagcctcccaaagcactggcattacaggtgggagccattgcgcccacgagggccacttttctgagtcaaagagggtgacttcttgctatgtcttcacatggtacaggggacgaagaagatcctttgggctcttttatcagggcaacaatcccattatgacatctccacctccacagcctgatcatcctggaaggccccaccttttaataccatcacgttggtgattacatttcaaggtacaaattttgggggacacagacatttgcaccatagcagacttacattgattttgtgctgtatttttttcctaggcctttaacttatatatttcaaaacctaattagaagggtatagttgagagacaggatagccaagtggacaagagtccatgccgagggagcaactcgtgtggagaccctggacgggaagtctccccgcacgtcgattcagagaaaggtaacggaataaacatgggagatcttggtgggagaggtcagagagagcgcggagggccagaccctggcaccttacagcatcctacatacttgggctttacctccagagagatgacgtgactggaaggtttgagtcgaggagtgaggtggcctgaccaaggtttgatgggactgccctgtctgctgtgttgggaagagaccacaggtgaccaagggctgaagcagggacacccttcaggaggctgtttctctaattcagccaacaagtggctgatgttcctgcacactagggaggtggtgatcagatatgaaaaaacagcattccaggtcagataagatgtggggaatgagacatgaggatgggccaaggatgagaccaagatctgggcctgagcaactggaagaatgcagttgcttcgtgttgtgattgggaaagctgtgggagaagcggtttggggttgaagttttctgttttgcagatgttgggtttgatgtcctgggaagttgaataaatgagtttaagagcaggctagaagttgggctatcttcttaggagtcatcagcaactagatgatgtttacagccttaagatggatgagctgagaaagggagtgaatacagatagaggagagagcagccctggggaaagtacagacttgtcaagctattgatagcatatttgcaaatggctttgaagaaagacccagggcactttcccaccagcagtgggtgggaatgagtgccgtactgcacacttgtctgttctctgtattactaattttttaatcatgaccaccttgaaagaaaagcttttcttgctaaattactgtttgaattgtaatttatttgattgtcagacagggtgaattttcataaaggtattagtcatttgcattacttgaagtgaattatgttcattttccataattctaagtcaaagagattatgttttattctgacatcgtggaagccactgaacatttttaaagagcacagcatgatgcagatggctatttgggaatattaatgggaaagttcctatccttgcatcctcttttattcattcatcagtgagtctgactccagagcttcaattttctgaaaagtttggaaaaactagctttggataattattagtcacgtgcaaatgagttaactgggtattaatggaatgaaaccactgccatttcttgctggctacagtgtgaagcaaccacttagggtcatccgtcagccttgaatcaagacacagagtacagaagacagatttccatcctcttctttgcctttcttcttaaagctaattatcagctcaatcctttatttcaccccttcctacaacaaaatgggatgcactagcattattcatatccagccttctctcagtgtgtagtcagggtagtcactggtgggtcattgtcttcatggaagatggtgtgacttccatacttagaaaccagcatcctctgatgttctcagcaggatatggctcctattgtattgtattgtattgtattatatttttcaattgacaaaattgtgtgtatttttcatgtacaacatgatgttttgaaatatacatacactgtgtaatggctccatctggctaattaacatactgcacaccatggcaactacagttaataacaatgttttgtattttgaaaatctctgagagagtagactttgtgttcttaccgaaagactttttaaaggcataaaacatgagtggttcacctgctggctctcactaaatcctctcatgcaattggctcaaaaatcatggaatagacagttcagggaggcagagtttggcttttggaattgctttcaggacctgggatatgttgtaaggacatggtctcttgaatatctggaatctgcaaaaaatgagtagtggcaactggagggactgggtttggggaaacatctcttgagcttggctctcaactaagccaacagtgccaactctgcttcataggcgcagcttgttttagaacaatgtgactaatttttttacacagttctgaaagcaattctctaaaaggaattccaaaaatattttgaacagcagcattattaagattagctgtgttccatcccaaggtgactcctgtataggaaatgacgctcactgggatgtatctgtctttcttggcctttcagaagcagtctcgggagattatggtcacacttgtgtacttgcagctttcccatagaattaaaaaccctgactaattaccagaaactcagcatttaaaatcactgtggataagagtcaggctagaactataagatcatgttacccactttctgtagggaagtataattcagcatttcaaatcagaatggaggtgcttcaaagatttgccattttaagaagaaaaaaaaaaggataacattcatcagagcatttgccaagagacagtcttagcactaaggcagctctcatccttctggaagcttgacagtcttaccatgatggtgaatgagacaagttttactatcatttcaggctcattgctgtaaatgtaacctttcttcaggtgaatgtcctaggaagaaaaatattgttccttacagaaaaaacaaacaaaaaaactagttaaagtatttcatgggaaaaaaactatttaaattcattattctgtcagattccgtggagggcctccgaggctgccagaaacagccctttctttgagcacttatttctgtgataccctgagtacacaaattccttttacaagtgacttttcctcagacaacaattgaattctaatgtgtttatcttgaacttgtattatggctggtagcctaagcattgtatttcaacagcctcttaaaagtgtccataatagatgtggaaaatcaaagtgccacacatccagttgtttttcagcttttggtgccttaatttgcatcgcctgatcagctgaggatctgctgagtgcagaaacaatcttcgtgcaccggctaatttatagcatggcagaacagttgttttctagacaacttgtaaggaaactgcttctcctcatttgtcttctgatcagagctgcacaagaactcttgatcatttacaaatgacgaaagtgagacttgtaaaaggtgagagtaaatcttctatcttattctcttattgtttgctacttggctttgatttatcattttgtgcctttttttttttttttttaacagaatctcattctgtcacccaggctggagtacaatggcgccatcttggctcaccacaacctccacctcccgggttcaagcaattctcctgcctcggcctcctgtgtagctgggattataggcatgtgccaccacgcctggctaatttttgtatttttagtagacacggggtttcaccatgttgaccagggtggtcccaaactcctgacctcaggtgatctacccactcctcggcctcccaaagtgctgggattacaggtgtaggccactgtgcccagcctatcattttgtttatatgaactataagccactagcatccacaaagggggaaatgtcttctgattgatagagcttccttttcttttttgaacaaatgctaagaagtagcaacagccaaaggacaagagctgtattgtcttctctcatgtgtggcaagaacaaacaagattgagaatctgattgcattgaagaggcattgttcattaaacttcctccagacctggggaagaggataaacttcctccagacctggggaagaagataatctgttccacagaaaatacagaatgcataacattcaatgaactttgcacagggatcccagaagtcttggctgtgatccaggacctaccatgactttctttgtttccacctcctgatgatcttaacccgtgtcatatagtttggctgtgtccccacccaaatctcatcgtgaattgtagctcccataatccccacgtgttatgggcgggacgtggcgggaggtatttgaatcctgggggcagatttttcccatgctattcttgtggtagtgaataagtctcgcaagatctgatggttttataaaggggagttcccctgcacacgctctcttgcctgccgccatgtaagatgtatctttgctcctccttcaccttctgccgtgattttgaggccccctcagccacatgaaactgtgagtccattaaacctctttttctttataaattacccagtctcaagtatttcttcatagcagtatgaaaatggactaatacactgtgtaacctctaagtttcctcaacggtaaacaagattttttttttgaccaatgatctctaaaattgcatttggctttaatattctgtgatttcatgaaaatttatattaaatttgccttatgttccatacagctctaagctgtctctggctaaaatagggaaacattgtacaggcactcccaggaagggaaggacgctccccttttgttctgtccaatttgggtaaacctttgtctatgtttatttataataactagaaggaaaaacagtacaagaatattctgtgtctttatcaacagcacgaacacttctgccatcttaaataagttaatttctctggatgcttcactatctggcgttgcaccagctgctgtgtggctctttaataggcatagaggaaacaagactataagcctttcagatcatgcaatgatttctctctaccaccccatcctttaccttttgttaaaatatttgcaatgcccttcacattgccacattctctctctctctctctctctctcacacacacacacctgcatagaaacacacaccacaggtcgtctccccttcccttttagttcccccccagcaggcagatttctctccctagccatgtcctgtgcagcctacactgtgccgcatcctgggttgtttagagtcccatagggcatggattggccagccacagcctgcaggccgagcaggcccccaatgtgtttttataaatcatgtatcgtggatcgcgtgggaacacagatgctgtttgtgttcatgctttgtcagtggctggtgcaacaacagcagagttcagttgtgagggacaaccatgtgtttgctgcagagcctaggctatttactttctgggcctttgcagatgaaagaggacagccctgctgtagggtgacgccatcatcatctctaaggactgctctcagggacaccatccctgaagtgtgagggattcaggggctcccctcatctaatttgaagcaccttttgtttttccctgtggggcctggcgacagggtacttctgtggctcagcaggcagcaggcaggtgagcgagctgtggccaggtgctgggaggcctccctgtggccacatgtagccttcgagggaatgtactctgcaggggtgtgaaagcgccccttctccttttttttttccatcaaggctgttcttgtttattttgaccagataataaaataacagtgtggaataaaataatagttgtgtaaaggaagatagttgaggttctaaggccagcatttgaggttctcttccacattttggggtaactcatgtaaatacaatataagcataacttctggaagctcattaccctaaatttgacctgctctttcccaacttattatagttctagagtgtctatttctgtaaaatatagggatatgcccaagatattcatctgaaggatcactgcacctgtgtgtgtacacactcacgtacatacaaacacgagcagacactcacagctgtcatctggaagaggagagtttctaggaccacagagacagcagtgcagaccttgttttgctacaaaacccacttgcaggaaacgaggaagcagaacactgcccagatgctttgctgagtcagggcagcgggagactgtctgtgagctgcacagtctcagcatatggtgaccaggatggatcctggtctgcaggtcacatgagccgacactgccagtaccagggaggaggctcagtgccagcacgtttggatggaaatgaaaacaaggcttcggcactgaggtagcggagggtccgtcatagcccagggtgccatcctggctggaggtgcagggacagaaggcccgggggaggagctcagggaccagccccagggatggcgaatgtcctgacataacgctgtgcccatcccagtgggtgctgaggaagctgaacggcagtgctgactctgggcacagtgatagccaaacaaactcctcacttgctgggctctgcggggcagacagtgaaggggagctgcaggtcagcagacagagagggaccagtgtcccgtgcatgccagagaaggggggggacgtgcccggtaggagggggagtgagtcatgaggggccctgtccgagagggatgccggtcaccacaccgggctcctctaaccctagcgttagtcatgtgccctcagctggaaagtagacaacttctcatgtcagcgtggcacatcccagcattgaaatcccacgtacaccggcctaacctcccacccaggcttctctccctaacctgccgcacagagtggaacctgcccctggctcagctggtctccctgccgtccgaggccccgttggcccctctcgattatgatccaggcttagtggatggcagcacagtgcatggtacataaagaaatggcatcatgcttggtacatgtcattttgtttatcctttacagcagccctgggaggtgtgcgaccttggtcccctctacaaatgaggagactcaggctccgttgcagaggcacaggggcccctgggctcacagcctggctcagaccccaatctgcagacttccccaccaccacgcgctgctctcccgttcacctgactccaagcttccagtcaaagtcggctttacaaggctttggtgggctccccagcccacacctgtgccccctgatattctaagggcggttatcacttgtagctaagacctggggctggttacatgttgcatcactctccaaaggcctggcccggagctgtgctcatgatcatcaacatgcatgtgatgatctaatcagcagtctgaaatgttatttaattttcttttatttccaagaaatctaatgtcacgtgaagcccttagtccagcacggggctgggtgcagttcccttaagggggaatgtaaagctattctgtctgtaccggcatctgcgctctaatactccctagaaaataagtaggaatcacagcaaagtgcaataggatgcaagttttgtctcctaagaagcttataaactggtgggtggagacaaggcattaatatctggatgggacaagcagggcagtgatgcagaaaaaaacacctctcagtatatgaaatgttctccaggaggtcagatgatccctgtcaggagctgaggaactgaagacaggccagcaggatggctggagcggccaggatggggctggggtggggaacgtcctgcagctgttctggggagaccgcgagctcgtcaccccacggcctccacctcttttcagtgcatagatagacggtgttcccatcttcccgcacgtagacagagtctgggactgagttaatgccactgaaatgtgagaggaatagccgggcgtggtggctcatgcctgtaatcccagcactttgggaggccgagacagccggatcacaaggtcagaagatcgagaccatcctggctaacacggtgaaaccccgtctctactaaaaatacaaaaaaaaaaattagctgggcggggtggtgggcgcctgtggtcccagctactcgggaggctgaggcaggaaaatggcgtgaacctgggaggtggagcttgcagtgagccgagatcaagccactgcactccagcctgggtgacagagtgagactccgtctcaaaaaaaaaaagaaatgtgagaggaagtgacgcgtgacccttcagtactgcctccagagccagggatggtacgcttctgtcgtttatgccaacagtgtttgtgggactttgtatggcagccagagtggactcacccacaaccagagttccacagggagagaaaaactcaaggtcaggactcagaaatcttgatcaacggacttacttgcaattggcctctaggcaggtgtggtcgctggtggacttagggtcccatggaggaccttggggaggctcagatcccaggaaagcagctggggaaccagggcggctatgaggagaaccccttgactcaggaaagtagtctggtctcaagttctagggccacccttaggatagccagaggaaggctagaaagccctgtgggcctccagcttccagccttccaaaagtgaggaggtggggctgtaagattacgctggctgatggctgtcgcaaaacactaagtttattacataaaagcctcaattccctcctaactatcaccaaaacagatgagttgtggtgtccagctcatcatcattgaagaaagaacacctcctttcttcaatttgttcttttgtgttttcttccctcttcagagctaactttttttttttttttttttttttttttttttgagacagtctcacttggttgcccaggctggagcacagtggcgcgatctcgcccactgcaacctctccctcccgggttcaagtgattctccttcctcagcctcccaagtagctgggataacaggcgcccgccaccatgcctaactaatttttgtatttttaatagagatggggtttcaccatgttggccaggctggtctcaagctcctgacctcaagtgaccatctgcctcgccctcccagagtgctggaattacaggcatgagccactgtgcccagcccagagctacctttgatgcccattttcatcatgttcagcttggtgttggggaaagcacaccaggagattcctgcccagggatggccctaggacaggtcctggagctgcccctcagagtggcccactgcatcacgtgaagcaagaacgcaccctttggttaagcctgttggaattacacatgccagatcccattcaactgagggaaaggatgacataggttcaaaaaaatatatgacaggtgctacgagggctgtcctagttctctcttagtaaggagaacctctgagacaggggcaagaagctccttcctgcagtgtattacatcctattcagagtccctttctctctgaagaatatgatgagctccctgcaaaatctgatctcctccctggttggaaggaatgagtggaacctgaaaagtgtggcatttttattgtccctggaatctgatctattaccttttctgtcctctgcctttcatcttcgttctactcatgcgtttgccccagatgagcaggtaagcttttcagatctggggattggggacttcccattttagatggaagtcctgccattgggttggctgaaaaggtgcgtaaggaatctgtcagatttatcacatggaagtctagggcaggcactgaaatccttttaggaaaaatgagtttccagggtagagaccaaacctctaagtcttaaagagagcaaagcaaagaagttgacatttagatctttcagcaaaccatgaagattctctgcctgtaggtgactagatgctagaaagagcctaatggatgagttgagaaagaaaacagccgagtcaagattgctaatgcgttcattacatgcatgtgagtgctttgctgtagaaagttatcgacgtccaaccccatgagaccattactgtcccatttagcctgacttctctcacacggcctcctctcgccttccctgcaacttcatttttagtttcgtattcctcaagacctatcccttaaagaaggaaagcaaagaatggtggaaaaattcacatccataaaagggtttctaaagctaggagccttgctaagctgcctgagttgtcacattgcagagtgcacggaatggccggctgagtctcatcagtgtggtggtggttacacacgctcattttgcctgatcaaatcgtttcattaaaaattcttaagctgtagacacaaaagtactttttcaaatacatcagtggcaatacagaagtagactgtaattcatttgtgtgcacttataatacaacacacctccccaaataaaatgcattttttttctgggtgttcactgcaatttgctacaatcagaaaaatcataaagggtagaatgatgtcattttttaatatattattttcatttttcaatgcctcgaagaaggtgcattaagatcatccattaccttagcgatagtactgttagtcccatacttcatatacagtacaaattcgttattatcagttaatattgacttagtgctcaaagtgttctagataacacacagtctataaagtacaagcgttaagtcacagccatttgcaatttctcttctgactgccaagaattaatctcttattcaacaaatattgttaagtgcctgctctgtgccacagttgggagcaaaacagacatggcctcggggctcagagagtgcacagctttccagtctagcaacaaagtcagacgttaaaccaacaattactgaaattagtcttaaattatagttgtgacagagacacaaaggtgagtgtggggcactgtgaggagtctgaaaaaaaaggacctcactcaggctggggttagggattcctccccaaagactggtttctttgaatggtttcattcatttgcttgccatttatttgaatgtgtcaagtcttgtgctagatttaagaagataagaaggtgaataagacagaattctgattctcagggaactccatgctctcatatgaaagacagctatgaaagcaaataattgcacagactttcatcatatcactttattgcattttgctatgaaagatactatgctgacatgcctcctggaaagaggaaccagatggaagctacacagattagataaaccagctggatcttagaagatcagttgataacatggcagttcatacagcatgaagttttctcttactaagctaaagtcgagaaacatgcccgatcgtaaggagcatcatcaaagtggcagaaggtgtaaagggaggttagtgttttgactgtatgctgggccagccaggacaagacatggcatggctccttctcacaagtaaaatcatgctaacaatgcactgtggccctctagcttcctcctccctcttttgagtctgtctgcagggaacaggcttttacagttccaggacataggatgcagaaagcacccagaaggaaagagggaaaactcattttgtcagtccaccgaaaagctggtgctgacctagccatgacagcacttccttccaaaccagaggatctatttgaatattggccaagggtcacagacatggagttcccatatatgaaccctccgttttggctttggtgggattgatatggacaaaacacgccgcaacttaagtgttgaagtcaagtgttgaagtcaagtgcagagtcacttgactctgtagcaatattgtctcaacaatagactaagaattacttgtgagtggttttgcactgaaatagtctctatgaggttgtactaggtgggccctaattttatagctaggggaactaaggtcccagagaggtgagctgatttactccatgtttcatgacacacagaaacggggatgggaccacggtctacccaccccagctgcagtgactgcaccatgggaactatttccccttgcatctccctgtaggactctgatgattcatgttgacatgtgttaaatgccagaggtgaagactttgacccatagagaagagagcccacctggggactaagcaggacttagttaccactccagctgccacctggagtaatcttcctgtctctactctttaagccccaattcatgtaagatctgaataaaagcggtgtgttcgccaagcatatgcgcagcttcaagacaaggtgtctggccttttctttcaaccagattgcagctccgaaatctctcctgtagcgaaacctggaacttccatagacattggtgctcccatctctgcacatgggagagggcacagtctgttttccaggagtgactgattgccttcaatagatcaggaaactaaccgcggacagaatcagttctacactgattttatactgtgaatgtttaaagtgaggcgttgtccctaacggaagggttagagaaatgtgcattgcttaatgggtttcttatgaagattaaatgagttcgtgcatagcaggcatggaacacacagcagtggctagcacaaaaatgagcccttgatgtgttggaatgtgttgtcattgtaaaccagccactgttggcaccagacagcctcggggtgctagagctgcctgtgacccacgaatgccatgtgaacaaactgacacagccatggcattttctctaaagcaaacacatgaactcagcaggtccctgaccacagatgtccatggtgggaggtggtgctgggtgatgtctgtaatgaagcagagattcctgggcccctctggggtttggtggttaacaattcatcccagtagtccaggcctggatcccacagccatggaatgattccctggcaggacactgctggagagagagggccccacagactccatcacttgggtgacctttggtataaaaggaaggaagaaacaggaaacaggaggtgactgcatttatctacagcagcctcagctgtctcttggcctctggggtccatgctgcagctctgagtctttttcagaaacgggaattcaaaggataaggttttaaatcattgaccatagagctgaaggtgtatcaggtacacagcaaggtaagaaatgcagtcccaatcttttcactggagtttctgcatggataatcagaggagttttcagaacatgctagataagaaacaatctctcttgcactcctctctccctctctctgtttctgtttgtctctctctcctttcctacacacttccccaggaaagttcgatttccataagctcttgtagctgcatattttacctgtggctgggaaaaaaaaggaatgggtagcaagccaagcacctctgaagcgtttctgcaatggcaacttaaatcttctgtgaaaagatgctggatagagaatactggatgagctgctccagtgtggaatggtgcctgaggaattgctattccccacctctattcaatttagcaccaccgttgtgcatgtttcgattaaaaagaggaacaaaacatttatgtactcattcaattcaccgctgcctttttatcacgcatcttctgtgtgccaggcaccaccccacgcctggcatcctgccaatggccatccttcccagggctggattttgcctctcctctccttgcgacttacaagaatttgcatttaaactgcacacttcacctgttggttgatacccaaaaccttcttaagagggaagaaagcttcttcatgacatcctcaatgacacgtaagtgccagttccctgtgagatcttgagggtgtggacaggtggccctcagaggcattggctggaattggatcctttgctgaatgctgcatactttaggaatggacggaggagcttcctgaggtggagaggaggtcagtaatggggaggagagagggcaggaagggaggcaggagaccggtctgtaaaatcaattttcccaactaaaaatgtaatgtcaggaggtagctgtgctccaggctgctcagatgtacatctaggcctgtctgtgtgacactcttgccagagcgggctgtgtcttgtgcagtgggcacaggaaggtgggatccctgggctgctcacgaggccgccccacactctgttcaggagacctagttatgagacggctgcctgtggttgcctaccattctgcctcttccctgccacctcatcagcacttttacctgtcgcctgcttatttaaacacgtggtccagcaatcacagtgagtgtggtgctgactgttgaatgcccatgctcagggaggcccttcacaaattctcagcaaggacttctctctgatgcatggttgacctgatgctaatggtcagctggccccagcgacactctggcattattttaccccctctacactttccctagattcgcctttccatcccctttttgaccgttctgattttgtaaaagccttgtttttcaggaaataccaatatacccttaataaagttttattaataaggtgtttaaaaaggacccagagtcaatgatttcatcaattagagcacgaaatacaaaagtctgaagatccaaaggaatgaatctctaatggccagctcatgacactatgtggcagctagggagatattttcgggcagaggtcttcccttgcctctcaaattctagaagtaaacatctgttgattttgtaatcaacaaaatgtattatatgtccgagagagtgacttgtcttggaaatttcagacatcagatcaattcggtacttgagtcctataccagggccactaaaggacttccagtccaaattccatcaaatcatgtagagccctcttttttgtccttctccatttgctcagctgtttttcctcccaagtagggagggcagggctgggaagcttcatcaagatttcctttgacacgctctggcttcagatagtgatttactttctaatgacgtgcctctgttttcattccctttccagtgtcaatctcagttgcaaacacccccaggaagccacacactcagctccattcagctccagccgtggtgtgaatgaacaaggaagtgagaagagtttttcattgcttattgccagaaaaatgtgtctgccagcttcagtgtttataaaaagcaattttgcctccccctaagctagcagtgtttaataaacatgtaatagagaatgtaggtttaatatttaagcatctctatgccccgagtctgagtgatgctctgctacattctttctgcaaaagggaatttaaaagaatgatgagatccagccccggcctgaaacaaaggcagttccagtggagtctgcagggttcactctttccttccctctctcctcagatagctgctccacggtttccccacttaggcaaatgagcatctgctgtgttcatggaaatcggtccaagtaacacaatagaggctgctgctcctggtgtgtgaaatcatcccccgaattatcaattgaaggaagattgcatcgtaaagccctggagcacgagcctcgttagcacgctccttccagcacagccggggctcggtccgtctggccatgtatttggcaaccagtgtgtgctccggcccaccctcaactaatgggtgtttgcatgggtgtgcgtttgtgcatgtgtgttcaccgccactagagtgagttcttttttggcagtttgtttgaacatatactcacccgaggcgtgtgcttggacctgtagatggacaaaagaggaaggcagcagggccctgccgggtcatgtgatgttgcagcggtgttctggaggacaccaggagggatgggaaggcagcgagaagagcgtgttggggactgcggtggtgacttctcagccaccttcctcgaaggggtggccttctccttagagggatagccagtcttgctgtgacgtggactgggagggtagtgccagcacacaaggaggaggcgggtgtggtgggaggcctcacaacacacggggccttgcaggccataactaggagggaccatcagtttcttatttttgtgtgggttttttttttttttttttttttgagacagaatttcggcccactgcaacctctgcctcccgtgttcaagcaattctcccacctcaacctcttgagtagctgggattacaggcacacaccaccacgcctggctaatttttgtatttttagtagagatggggtttcaccatgttaaccaggctggtctcaaactcctgacctcagtttcttgtttttgaaagatactcaggatgaggctgcagacacaggaactgtctttctcttctttgaacaaaccaagctgttttttgcctcaagcgctttgcgttctctgttcctgctgctgggagcaccgctgtgctttgccctgtccaagatgtgttctttcccacaggtgttggcttagggtaactgactcaggagggtcttcccggcagactgcaggctctgaagggtcacccacccttgcgtacactcatgttgtaaatgagttttgaccctgctggtgccaacaactgctgctctgtgtgttcttttagaatgctgcctggcttggaatgatcttgtttctgtttacttgttgattgtgcatctgctttcttctctttttgtattttttgtgagaagacaggtccatctccctagtttttccctctacggaagttcccagccatgcctggtacagagcatgctaccaattaatatatttctaatggaagccagaagctgggagtccaatcagaaggcgaattgaggtatcacagagcaggaagaatggctgcttggactacatagaggcagtggagatggaatgaagaggatgggtatgttttgagaggaaatggatgacttgtgagactagaaatttgggaagttagaaggatagaggaaatggtctctagagagcacctcgtataagaataagaggcacagggttggcggtggaggcgcttggaggcacagaagggtgctcttcctacttttttcttatcgtaattctcctctgaggatacaagtaaaggtcttattcatgtggataaaattgccaaattttatgtttctcagaagcagttttgtgaatcagtaagtgtgaaggaaatagcccaggtattaaagggaggaatctggaaaggtttgggccgagcagcttccaggggctttgtggccttgggttatccttgtcctcgtctaacctgcatgccgtgttgactgagtatggaattttccccaaatctttgtttttattgacgtagaacacgattgattttcaatcagttgatcaaattcctaagtggagcacactggaatgtgtgtggccaccttctgagggttcatgaaaaagaagtggaaggattccaagagcagccaggctttcaccttcattgaagctgcagcctcgtccatcagaggcacagacacaagaaacatagctctgagcagaaaacacagaatacagctgttactggaaaggggtccagtccagacctgaagagaaggttcttggacctcacgcaagaaggaattcagggcaagtctatagagtaaagtgaaacttgattagagaaataaagaaacaaaagaatggctactccgtaggcagagcagtggcataggctgctcaattgagttagttatttctggatcatatgctaaacaagggctggatcattcatgagttttccaggttggggcagagatttcacggaactgagagttcctccccatcttagaccatatagggtaatttctggatgttggcgtggcatttgtaaactgtcatggtgccggtgggagtgtctttcagcatgcgaatgcattataattcaagcagtgaggggtcactttcattgacatcttggtttcgatgggttttagacggcttctttactatatctcattttatcagcaggacctttgtgacttgtatcttgtgctgacctcctatctcatcctgtgactaagagcacctaacctcctgggaatgcagcccagtaggtctcagccttgttttacccagcccctattcaagatggagtcactttggttcaaacgcctctgacatagctgagcattaagtaccatagcagtttggataagtgggaagtaattgatatggatgggcacaccaggtggggaggactttctggaaatagtgatacattgatggtaaatacgatttggctgtgccaaaaagatggagaattttaggcagagggagcaatttggtcaagtgtgaagacagagctgaccatggagcagtttaacttttcccgacataaaatgcgaatttccaagctgaagaggagcggatctagagcccaaggtggctaacgctgccataagctagtttcagtcccgtctttgctgacggtgtgatattcctgaggccaccggggatgattcacaagggtgtgccgtgattccctttcacagaagcagtttaaaaataaaatctcttgcactccctcttagccaaaggaatccattgaaagccaccaatgtacttcgctagcagtagaagcgtcccatttggtggatgatgcctttcaaaccaggatcacttactgcattcctttcccagagctgccgtaaccagggacctagacctggcaattttaacagcggaaacctactggctcacagtcttgggagcctgtaggtctgaagtcagagcatcggctgggttcattccagggctgcgagggagggtctgtctcaggcctgtcttctcggcttgtagctggctgtctttgtgttcacccagcattctgctttgtagaggagtaaaaataaaatttacctctatcttcttaagttctctagccaggccctataaactagactggcaaaaaataataataataataagagaaaattacacagatttacttaataagtcccatgtgatatggaagccttcctaaggcagtggagacctgaagagacagtgaagacctgaagggacagtggggacccgaagagacagtgatgcctcagcgctttctgtagtatgctggatgaggacgcagaggtcatggggaagcgtgacaggacaaagggagtgagctgagggtgatcggtgggaaccgcagcaaggtctgtgtgctcagcctcctcccggctgcctctgcctttggagatggggatgctgtctccagtggggcatttggagggtgccgctcacaggtgggtcctaggacctccttctggggaggcggggaagtcggatggtccttcctgcgcctgacactgctcacattcttccagcttataatattcagtatgccaaggtagcatctttgtggtagtgtgtcctgaatcacaccagcctctgtgccagtctgtgtccacatttccccttctcataaagacactggcatgttggattagagccataccggtgacctcatggtaacctagttgcctttggaaagaccttgtcttcaaataagctcatattctgaggtattgggcattgggacttcagcatatgaatttgaagggatacaatcaactcataaaattgccatgattttttttcaaataagctgctatttacttttaaaaaataaagtccaatactgtggccatattgctttctgtcaccagcaggtggcatttctatagtccagggatggcaaaggaagagccgagtgctttcctgttgttttatttggaaaatgaagcattgttatgtacgggtgagagagagagcacagattaaactttggaaatgatagtcaatggtacatgatgatgcatggagacttttgccataaattctagacatattacaggaaaaccagcaagcccacaccggttcccatggaagtcaggaatcacactggcttctgggcttgaccctgtcaataaccagcttccaggctccgaccaaaacacttagaaataggaatgttaatactgagataattgtggcccagagacattttcttctctaccttcctcactgtttttttatttttattttttttaggatcagatgagataaaatatgtagacttattcaaaaatgaacaaaatataatacaacttaaacaaaggtcccacttacctgtcctctataatatagactaccttcccttcaaaacaccctccccgagaacagtaactgcgaggaggaactttatttccttcaagcagtaatcaagcctggcccatacgagatattaaacaggcatgaaataaacaggcacaggtaaagatgactgaagaagttattctgattcacatttaaggattgacattacttcaagcaaaattgggaaagaatatgaaacaaaagacgtgtggtctctactctttaaaagctcacagttaattttgctgtatttttaagagaaaagcaaaatggatatatataaaacagattaatagacgactgaattgctccaaaatcattcattcgtttatgacacagtgcggtcctgagactcctcctgcaggcagctggggtggtctctgcccggagcatcggcatgagccgcactgcagtggagtgagtgttgcctggtgttgcccacactgatggatgtctggaagtgcagctaagtgcagccacagagattcactgtaagagcactggatcctttactctgagaaggagatgtggcagtagcgcctggtagcataggccccgtggccccttgtccctgaagcttcttccgttaacagacctcacagagcccagccctcatttccttgcagctcaatccatttctttccagtctcggagatgcttttcttatgactcaatcaagggcttgcatggtgtgtggtgctggcactgctttcagaggctgcctgatgattccgagatccctctgctactttttcgtgcctcatgcgtcttagggaaggtgtttgcaggtgaaggaaaaggtgggtagggtagacgttcaaagggaatcatgaacttgttttgtgtctcttcaaaaaaactgagcaagctgattctcacacacctaaacacgaaagcattttgttactaagctctggactgtaacaccccaaactgcatatgtccctgataaactttattttcctctaatcacttggaagaaccgagtttactgtgtgtaactgcaaggggcaaagagacattggtgagtagaaggtagaaaattcctccttgcatgaaagggaagctggcttctctgtaacaattgttgctatctaaagctagtgggaaccagctggtgggaataaactaagcgccccttgaaaggctgaaacagggtctggagggtgagtggctactctagggggatcccagcactgggttagaggccaagctggattaatctagtcaacacatctctaatgttttcctagcttgagtcagcactgagtcgatttggtataagaaagaaaggaaacatattcctgtggggagacagacagggcaagagcacttcttataaaaattagcatacagagggatcattaggctcagcctcaggtggaacaggtgcctactggaaggagcacctcggtttacctggggacagggtaggaaaggtttcaagggacaggaggcatttaagaattaaaattaaacactgaggcttctgggttgaataggagtttgtcaggtagacatggtaggaagggagtccaggcagagatggcggcatgtagaaaaataacaaggcccaagagagccgctgaaacttcatggaatgttaggtgtgagacaagaggaggtagagctggactaggaattggaagcctggttttgaagatccctgtacgttatgcgccgggagtttgtaggtgatgaggaggtatgacataagtctcagcaggggactgccacgatcacatatgcttgttagaaatatgtttgcaggtggagaagagactggtgagaagtgagggtggataaagaagcggtattgagaggtaataccacagcccaggaaggaacgcctgaagtggaaataaggaaagattggcagccccttaggcggtggactcagatggactgtagcattgcttacagagagaggagctgtgagaaaataagtgtcctatttcttaccttgccagttgggtggatgctgacctcattcaaggaaaataagaaggagcagagggcagagaagatggagatgcagacatggacatgtacaatggcaaggaacatatcggtggtggatgcagtaaagagttggctctctaggtctggaacatagaggtcgaacctgaagatcaagctgggggtcaacatgtctcgtggaatgcaagccacgtaggtgtgcgtgcggtgccctagggagagaagacaggatggagcacagggagcggccaacacctaggtgagcagatagtcttccctaggacagctcacggcagggagagaaaccatgagacttgagaagcaacagaagggaatgcagtgagggaaacatttcaagtaagagggaagaaataaaaaaaccggaggtcaaagacaggccaaagttcccattgtctatccactgcactttggtggccctggcgagagctactctgcagaaaagtgagaagtgaaaatcagagccctggggctgagaagcgcattggaggttaaaaaaacccgggggagtgagcgtggaactcgccaacacgcacagttgctcaccctagcacaggtgcatctggacgcaaagcaagggggagagtgagggagaatatctgacctgctcctgtttcagctgagattccagcgggttagaagcgctcgaggtcagtcaggcaggagctggtgagatacacgtatgggggcaaggaaacgctacgagactgaggattgagctccactcttttccactctgtcaccgaatgtgtcaccctcctcaaatggagtgacccaggtgtcggggactctgtctcagtctggatccctccccctggcagtcgccactgacatgctgcagctgctggatgtgcaaataactgatcagccttgctgtccaggaatttacaggcgtggtgagattattttattttattttatttctggatactatcctaaaccttcccacaccaaacacaagaagttttcccttgctttcttcccccactccttgccttggaacatgataatcaagaaaaactgaccaggtgcagtggcttacacctctaatcctggcactttgggaggctgaggtgtggggatcacctgagctcaggagttcaataccagcctggtcaacatggtgaaaccccgtctctactaaaaatacaaaaattacttgggcgtggtggtgcatgcctgtagtcccagctactcgggaggctgaggcaggagaatcacatgaacccgggaagcggaggttgcagtgagccgagatcgtgccactgcactccagcctcggtgacagagctagattctgtctcaaaaaagaaagaaagaaagaaaaaactactgaatgaatctcattaaccttttgaacaatcctgtcactgtgggaagtttgtcctcgtgggttgtggtagaatgtagacctcttaaatacaagacccagctcctgttagcctttgtgaaaagaatagtgttttaacacttagtatatgctcaattaatgtgatatcaaaagcaattttctaccatttgtgttatttcagcatagctgcctttcatgtgtaccctgcaaccacattgtgaaatagacattttcattcccatttcacagaggattaaactaaggccagaaagattaagaaactgtttcaaagctatataggctgctgatacatcacttatatcactaggtaaatctcactcagattcaaatccagattttaattctatcaagtatatgcaaattaaagaaagtgttttattatttttttcctggaggggattccaagaagaagggtaatcgcattttccaaattcagactgtgatgagcacagtttattacggagcatccatccccacatggggtgaaatgtggagaaccaatgtcttatgagcacctttgaatgaaaatcttgagtccttccagcagagaaaggactttttgaaaggtttatttattcctttactacattccattcttatcttattaatagttcataagtctcagctaaatctctaggtcatagtaaatcacatccttcactatgagaacttgagatgacacaagcattcagttatagcaatttatagcaaatgcttaaaattggtatacccacaatctttcaaagccctgtcaaatacaggagtcagtcagatacaattttaaaaggcttaccatagaaagctctaaatctttgcatagtcaagcatatcttaatccaggagaaaattatttttgtaaacctttcctagaagaattttatgtcctgtattacaatcttataatgtggcagagggaaggtgggaggaagggagataaatacccatgtttatctccagcctgcagcagtgaaatgagatagttcaccatgtattccttgaaaaccactgaaaataaatatcaatactaccattatcttttaaaaaaattcagtagtctttcccacttgtcaaaacacttttttaaaatcttcctttaaatttccagagtgtcctcatatctagtttgcattttatcctcaacaccacaagaattaaataagggttggtattatcactgccatttatagataaggaaacggaagccaaagaagttgggtaatttgcctaagatcacacagctatttagagatggaactaaggaaatgacacagatctccaagcatttctgtaaattttttctaagtaaaagatgtttccttcttttcccaccaaccctcaaaattccgtgtgctgtctgtggaattcatgcacagattgctgtggttcggggaaagatcatgcccaggacgtaggggataaagagggaccagacctgcctcatctgtgccctcgctgcatgggcctgggcaagtcggtgatctgtcagtatcccactttcctctccataaaatgataaagctgggaaggaaatggtaaatatcacctgatcacctggattaaactctgacttggaggtttcttggctatactgttagtcagcattctccagagaaaaggaactaataggatgcatgtgtgtgtatatgtgtgtgcacgtagacacacacatacacacaaagaaacaggatagatgagtgcatgtgcgtctacaggcacacatacaaagacatttatttcagggaatttgctcacctcatggtggtgctggcaagtctgaaatctggagggcagcctggcaggagggaaatgcaggcaggtcttccatgttacagtcttgaggcagcactccttccttcccagaagtcctcagtttttgctcttaaggccttctgcaaatcaggggaagcccacccatattctagagagtcaatctccttcacgtaaatgtcagctaattacagatctccatcgcttctataaaatgccttcacttgaacacccagacaagtgtttgaccaaacagctgggcaccatcgcccagccaagttgacatctacaattagcccttacaagaaaatgtcctttggactataatgtttgtctgtaaagtgtcactatcgcaactatgatgtgtgtttctttggacaaaatatacattagttgaatagtaaactctgaccaaagatgtttagtattaaataactttcttaatagtcaaactgcagaactaaaatttaaatttctactaaattttgtgtgtgtctacccataattatctgctgattctcatactttacatttgaaggactctaagctcctgaatacagtacagatattcataatttttggagacggtttaccagattggcacctcatgaaaatggaatcaaactgtgatgggtaattttatgcatccacttgggtaggccttggtgccttgatgtgtgttcaaacattattctgggtgttttgtgtgagtatttttggaagagagattaaatttacatcagtgaacttcaaataaagcaggttaccctccatcatgtgggtgggcctcatccaatcagttgaaggcccaaatagagcaaaagactgaccgccccagttaagagggaattctccagcagacggcctttggacttgatgcacctctttcctgtgactccaacctgttggtctctcccatgcaattttggactagccaagcctccacgatcatgtgaaccaataccttaaaataaatttcttcgtctttctaaatgcatatatcctcttggttctgttcttgggagaatgctgattcgtgcataaacaaggctgaaaggcaatccttactatcgggaaggtaagaaaaatgaatgcaaggtgtcagaagtgatggttggtgggtgtgtagcattggggcaaattgatatttaaaaattaaactctgttcggctagccagccttcttcagtcttcagactgcgagaatgtagcatctctgaattttaacagggcatcatcaagttctgtcataatgttgttatagataagatggaggaaaatcttctgggaggtaggaaaacaaggggtagattaatgtaaacctagagggaaagtcctagtaggtttttagggaccactgttctttattgtgtcctagtgaatatttgtctagatggcttcatggagaaataaaatcttcgtggataaagaaatcatcatcattatcaccgtcatcattaatgggtatgagtacttaacatggcctattttgtgctttatatgtgttaccttatttaatttttataataatacttgttagaataggcattattgttgttatttatttatgtatttattttgagatggagtcttgctctgtcacccaggctggagtgcagtggtgcaatctcggctcactgcaacctctgcctcccaggttcaagcaattctcctgcctcagcctcccgagtagctgggattacaggcacccgccaccacgcctggttaatttttgtatttttagtagagatgagattttgccatgttggtcaggctggtcttgaactcctgagctcaggcgatccacccacctcggcctccaaaagtgctgggattacaggcgtgagtcactgcgcccggcccgttgttgttattttagaattaagaatttgaaacacagaagatgttaacttgggaaaggtcacacagtggtaaatgggagagcagggatttgaactcagtaagtatgatttcagagtctacactcttaacccatgtgcactctcagatatagctactgaatcagaagatgatataaagaaggaggaagtagtgattgtgtggagtgacagatgtggcccttcatcccatcccaccaggattcctttggattgtggtcctataaaggtgcgtgagaagcagatggatgttcagtaccgcccctgggcccagttcacagctgcaaaagtaccggatggagcagacattaaccaagagtcctgtgaccgagccaagggtagacccaatacaacctggtgtaggaggcagtgaagttgacgaacacttcggctgtatcatcagggaagcaacacttagatgtgggcaggtgggggctggtccagtccatgctgctcagaccccacctgcaggggtgctcagtgtagaatcaccattcagaagggagactgggctgaccacggagaggcaggagacaaggcaggacatggaggatggacagtagtgcggtttgaggaaggcctgaaagaattggcagtgtttgctccagaaaagagacagcgaaactcagggctggggataggagatggacgagcatcatgatagcatctcggcttacagagcatagaaagcccaggtgataggtcttcctcttacctctgcagcaagttcatggtgtgactgagggggtggccacagtctcaaatagcttccccaggtgggtctctgtgtcacaggccatgtgacttcaggatcccaagatgctcattctggcacatttttcagcaggacccaaaggatcaggctgtcttcagctgctaagaggaccagtcttttgcgagtctttcttactttcagcctgtcattgggcagatttctgaagcggaacccagtcctggcagcaatctttcttctgtctcagctaatcccagcctcagcacacagtgcaacattttcagtggtcttgtgtctgtaattatctttcactgtttctagaagcaacttcattgtgcaacaccattgctgtctggaagggtcattatctggaatcggttagttctaaccagctccttacaaactgcctttggtagcaaggctcttaggatttttagagtgttaaaaaaaattccgaaacccagatatgttcttagttgtaaattctgactaataataagttataagaaagaagacttcggaaaagtgtgtttgtaaattctttatattgtttctaaatggggtcgattacctgaggagagatgagttcctgccactggtgatgttctatcagagagacaagcaaaacatggaaagctgaagtaaaataacctcagggtaagagggagaaaaacagtaaatggcatgggtgtggggttcagggtactgagatgtcagaaaaatcagtacagaatgtgagggagaaggtgtgaagagtccaaggacgccacctgctcttgcactccgaaccctccccgctcactagcaagtccacagactgtctgctgaatttgtctacaaacagaaaacaaggcactgtggtgcctgttgtatagatgagagagcataggcttggggatggtgaaatgagccttctccggcctctcagactcaggctttcggagtttttgaataaacctaagttagtccacttcccggccacatagaagttggagcagtaaagctgatgggactgtttttcatatgagatgcaaactcctcaggttatggcaagtgagggcgagaaggaggcctgggcaagagaaaggacttgctttattttacatcgctagtttatggaagtaccagccaacactgaaacttcctggcctccaatccagtggggttattcatcctactctccactctctctgttttctgatgtttggaaataaaaaaaatcagaactacctcattaacgctctctttcctctttcatctgaagcagtgtgttagttaactttctcaacaagtttacatgccctttggctaataattgtggagaggacctatgactcactgtcattagtgtagactagctgccctagaaaaattgctcgggcgcggtggctcacacctgtaatcccagcacttggggaggccaaggtgggtggatcacctgaggtcaggagctcaagaccagcctggccaacatagtaaaaccccatctctactaaaaatacaaaacttagctgggtgtggtggtgggcgtctgtaatcccagctacccaggaggctaaggcaggagaatcgcttgaacccgggaggcggaggttgcagtgagctgagatcacaccactgcgctccagcctgggcgacggagtgagactccatcttaaaaacaaacaaaaaaacaagcagatagaccacaaaatagacaatggcttgaacacaataactgcttctgttttcctgtgtaagaggttagtgaggcaggcgcagggctgggggagtgcacttgtaagtgggctttgtcatcttcacagtatttttccaatgttgtcctgaagcgttgcctcattccctccacccgagcaggtagagaacagggaggaccccatgcaggagctgttgcggttctaacacgcatcctattctcttgggcagagctcagtcactcgaccatgcccagctgcaaggcaggctgggaatgtagactaactaggtgggtgagccagggaggaggaggagacctcaccctagccccagctacacttgcaggtcgagccaagagctgagggttttgcatatactgggtacactgattcctgttgagtctgcagcctgatttattttgtgaaactctagaatcatcggaggcggggttgcatccttggtacagccctctttatcattgccccatggctggggctggaggacagcaggaacagacactacaacaaaatcagctctcttggctccaatccctgaaagcccattgctatttctccctgaacatctggcctgtttcctggggtgtgtagagagaggccttctgttccttcagggcctcagctcagcacctgcgaacacagacattaaaaaaaccctcaagaactgcttggcaagcgcttggaacacagtctgctcagtatgcaccttcccacaccccctgcttgtagtaataatctttacctgcttggcagagcacgccgttgaggggatacatcacttcacctgctgagatgagtgcagagattttctaatgagaggcatttggtggcaaaaattaattatgacatatttcaaaggcaggccaagaacctggcctcctctccgttcccatccgatgcttctggtcactaagggaaagagaatgacaataacaataagtcaggacttttttttttctgttgtataaatagcagggaaggctggggcttctgacttcagcaccacagaatttttctgcagtgcctctttccctggcacatagcatgctcgttactaatgggtcctaaatgaaccccaggtgtcctggtgctcacctgtgggttgaatctcccttgctcagtaagtgtagaatccctctagggtccacctattttggagggactcaaactaggagtcccctaattgcattcttaggagaaggatatgacttcttgagatgataaaggagacattacctgcagacatttcaggtggaaagccaaattgtgaactttttcttgtgcagcttctccatcagcacttgctgcttcaccttgcactatgttatggagatggttttgctccttaaacctcatgagccaatctttgctagcttccagcttttcttctgcagcttcctcatttttctcagcctccatagaattgaattgaagagaggtagggccttgccctggattaggctttgtcttaagggaatgtggtggctggtttcaccttctatgcagaccactcaaagtttcttcatgtcagcaataaggctgttttgctttcttatcattcatgtgttcactggagtagcacttttaatttccttcaagaactttgcctttgcactcacaacttggctaactgtttagcacaagaggcctagctttcagccgatctcagctttcaacatgccttcctcactcagcataatcatttctaatttttttttttatttaaagtgagagatgtgtgactcttcctttcactttgacactttgaagctattgttggttgattagctggcctaagttcaatatcagtgttgctttttgaaaagagtaaaaaaccatttggagccaaatcaagcaaatgaggtgtgtgatcaaactctaatcacttagatatctgatatcacttagatatctgatatcataaagtaaaactttatgaagtttggggtacctgtggccatttcttaaaataagacaacagtgaggtttgccccactgattgactcttactttcataaaaggttctctgtggcacgtcatgctattttataacattttacccacagtagaacttctttaaaattggagtcaatcctctccagttgacttccttgtgtacgcataattttataattcaaaggcctagttttagttggacaaaaacacattggtcacattcttaatagccgcaccccaagtgagccaggaaaaatgcttgtaggaaaaagctgtaggaatgtgctcttcaccttcctgcaaaagattagggatggttgatatgtgagggaaggtgaaagctggaaagagtgagtgataccgaactttattttttcataggaaatacaatatttccttcactgagctgactggtcatctgttggaccccagcccagctcagcttagcagcctgtctgtgtgtgcacgtgtgtgtgtgcatgtgtgtgcgggtgtgtatgtgtgtacatgcgtgtgcatgtgtgtgtgaatgtgtgtgcatgcgtgtgtgtgtgtgcatatttgtgtgtgatttctccaggtgccctcatactgtgtggggacaatgagttgattgctcccctgctgtgtcactgggtgatctaggattatatcactgcctgaggacatgagtaccttttcctttgctgtcccctcaggaaaaagcccagtgtttcacagttggctgtccaaagggaggactgttctccaaccttcctaaaggcccatgtgtggggaaggatggcagtgcttctgacattgggcatggcaggtatgttaatgaggcagctggaaagccatgcccggctttgggcttccatacatgtgattatccctaacaccttcttttatgattattaggctttgaaaattgctctgagctatttttaagaagtctcagaataaaaagagatgatctgggaaggtgagaggagccgatgcccagccactgttaagaacaatggtgtttggcatttatctaggtctctcatcatggttcaggcaggaactccctagccaggtggaacctgtggcaggaatccacaagctgtgagttcaagcctcatgccagctgcctaagctcctatgagaagttggtagatggttcatgtcctttttcctcatttttttattttatttttttttaccagggccagtcttctgtgtaggcagagtgggcagaggcacagatcgtgtgattctaggtttatggagagcacgctcttttcaaagagcttccctcgctgctgtctgtgagtttatctgtgacctgctacagcagcagtccccagactttttggcaccagggactggtttcatggaagacaatttttccatggaccggggagtggggtggggtgggatggtttcaggatgattcaagcacattgcacttattgtgcactttatttcttattcttattacattgtaacgtataatgaaataactgtacaactccccataatatagaatcagtgggagccctgaacttgttttcctgcaactagacagtcgcatctggggatgatgggagacagtgacagatcatcaggcattggattctcataaggagctgacaacctagatccctcagttcacagtagggtttgcactcctatgaggatctgatgctgcagctgatctgacgggaggcagagctcaggcagtaatgcgagcgatggggagcggctgtaagtacagatgaagccatcattcatggctcaagttggggacccctgtgctagagcacacacacagccattatatgtcccctcttgtggctgatttgtttactgtgggagcacagactacactgcagaggagagcagagctggggggaaagaaatggcggtggcatcactttgctgggaaaggctgtcttgttctggaggcaggataaaggcagcatgaatgcttctccagaagactttatcttacaagagcctgaatggatgactagctctccaaaagtaaagcactggaagggaagtgaggtgccaggagataatagttttgaagactagtcctgtgaaacggtgtttctttgtactccaatggcctattttaaatccttatcctatttgatactgtctgcagaatctgatgctagtgactccttcttcctttctgaagctcacttcctccttcgctcctgtggtaatagccttccttgccttctctgcaaagttttcaagttctcgtcttttgtgcttctcttcctctgcctgaactttcaatattgacgtttctggttaacaatctaagatcatatggtcactgtgtgatttatgttgtctactccttggtgtcacaaccacccaccatcatgccgtacagtcggtcccagccccttacgtgagctgggtttttattttggaacttcctaacaaacgtttctagatgaagcccacagagacccgatgctcaggaagtaaacctgtcaagaagccaacacattatttgctcctccaaatgttcttgtttctctgtgtttcatgtcttggttactggtactatcatccacccatgtggaaccatctagaagcctaagaatcaccttcagacaccaccttcccaccccacaaatactctacattttagcagtataagactgtagcagtttcttgaatgtaacatgacatttctcatttccataccttcatttatgttgtttattcttggaatgctcttccttcattttgatgcttcacacgctaatacacatccttcaagacccaattccaatgtgttttctattttggggcctttttgactctcctacgaagactaaattaactgttccttcatttgtattctctaaagggtttgtactattttctatacatttattaaagacccctgagctaagacaacctcctaagaaccctcattgtttcaaggaatataccatatggaaaagtagaaaatgagagtaaaagggaagctaatgtgagggtaggagggaaggtgaggcagaagaggtgaaaagaaagaacagagtaaagtccaagggtaggggagttgagtggccacgctcataaggagctttgccacccctcggtttcccgagcacctgccacgtgccaggcactatgggggctttagtgtagatgatttctccctcgtcttgctccttcatagcaagaggaaggaagcaccaaagtaaaaaacccgagaaaacctggagaaggtgcccaggttgtctcactggtatttagtgctcctagggtggctggaaaaagcatcccgcttcaagaggccaccatctgacacagagcacccaggtactctttcctgtaaagcagaagtccccaacccctgggctgtgaatcaatatgtgtctacagcctgtgaggaacagggctgcacaggaggtgagcagcaggtgagtgagcatgactgcccaagccccacctcctgtcagatcagaggtggcattcgattctcataggagtgggaaccctattgtgaactgcatgtgcaagagatctgggttgcatgctccttatgagaatctgatgcctaatatctgaggtggaacagtttcatcccgaagccatccccaccccgtgtcccatccatggacaaactgtcttccacaaaaccagcccctggtgccagaaaatttggggactgctgctgtaaagcatgcacagtgcacgaggcctggttgagctctgagacttggctgagcccttgcagcagaggtgactgatgaggacacagcatcaggtcgtctactgcttcctgaacttgtactgactttcaggtctttttaccttttatttatttatttatgagatggagtctcactctgttgcccaacctggattgcagtggtgcgatctcagctcactgcaatctccatctcccgggctcaagtgattctcctgcctcagcctcctgagtagctaggattgcagacaccccccaccacgcctggccaatttttgtatttttagtacagacggggtttcaccatgttgatcaagctgatctcgaactcctgacctcaagtgatccacctgcctcggcctcccaaagtgctgagattacaggcgtgagccactgtgcccagcctgagtttcaggtcttcaaacaaaagttcacctgctccagagttgttgaaatgtaatgcattttctggaaaacgtgtgtctcattcatctcttgttggcgtttctgaaaataccacaggttctggagacgctaccgcttcatgtctcctagcagcactggccatctacctgggcacaccagggctccgtgaaaatgtgttcctgggatgccagtgtttccaccctgggatccaggaggcctggctccaaaccccaagtctgcacccactacctgggagatgtaggggcatgacagctgctcagaggtctcagtgtcctcacatatattccaggaacagtaggctggttgggccaccggcgccaacatcctgtggtgatttcttcatcatgacagggtttcgtgtctgtgagatgcctggcgagaatctgtagcaggttgcatgagagctggcttggctctgatgctccacattcttctccgtggctcctttcctttcctttcctttcctttcctttcctttcctttcctttccttttccttttccttttccttttccttttccctttcctttcctttcctttttttctttcttccctttctttcccttcttttcttttcctttctttctttctttctttctttctttttctttctttctctctttctttctttcatttcttttcccttccttccttccttcctttcttccttccttccttccttccttccttccttcctttctttctctcagaattcagactttggttaattgtgacaaacctattaataatttctgctctattagtttcctcatacaatacagtgctttatctgtcagccagagtttccttggtgtgtaaccgtggctcttatccagtgtatctcataatatttattttctgaaataatcgagagcatatgcttgttaatgcttttattagttcacatttgagaatgggttgccagtttgcagtctagataatattatggtgtctctgcatctgcctgtcagctgcatctactacttgaatgtttggttatttctccagcctcccctcattaaccattccggttcctccttaggcagcgctcctcatggccactgagcatgaagccaaggtccctgcagtgatatcctacacagacaagggtgtaaatagcttagtttcatcaggctgttgaaaatgacaccattctccatgcaccaattctttttattttattttttattttttgagatggagtctcgctgtgtcccccaggttggagcacagtggcgcgatttcagctcactgcaagctccacctcctgggttcacgccattctcctgcctcagcctcccgagtagctgggactacaggcgcccaccaccacgcctggctaattttttgtatttttagtaaaaacggggtttcacctgtgcggtggctcacacctgtaatcccagcactttgcgaggcccagacaggcggatcacgaggtcaggagatctcccatgcaccatttccatcatatttttgttactctgagtggtaacagaacctgtagctgctctgttaacctggaaacgggcttgctttgtacaaaaaaagttacctgctttcagatggggccggtgttcatttaatttttctgatgacacaaacttgatgatgatgaagttccctacagagaaagtcacactagaaagactgataagttttcagacccttgaggttggccagaactctaaagaagaggtagatatggagagacttggtaaaaggaatcatcctgacgtagtgacagatgggatgtggaagatgaaggagagggtggaatcaaagacgaatcatgaaagcgacccctctcgtggcgttgaaaagcttctcagttgttggagaatctttcacattgtgagctgattagattgaaaaacacacatatatggggctgtgacctgaactatatctgacgaagtcagcaattgctttgtgtgtttgtgcacgtgttcatgtttgtgcatgtgttcatgtgtgtgtaaatgggcctggtgtttgtgactcagtaactttttctaagagaaaacacgcatcctcacccttgcaggggaggcaccagctgtcagtggtgaaagagagagaagggtcttcattcccctcgtcttccctctgctgtctccccagccctttacctcccgccttggccccttctcccgttcatcttcctctcctcctgctccagagaaggaagtaattaaacggtctgtcctgtgttggctttttttttttttttttttttttttttttttttactgcatatagccctttttttttaaaaaattatactttaatttttacagtatatgtgcacaacgtgcaggtttgttacatatgtatacatgtgttggctttttaaggatgtgagacttgtaaaaacaaaatactatgagtagaagtatggaacaaaatgacaagcctcatttaccttaaaataagaaatctcttggccaggcttggtggtggctcatgcctgtaatcccagcactttgggaggctgagacaggcagatcacttgagctcgcaaattcaagtccagcctgagcaacatggaaaagccccatctctaccaaaaatagaaaaatgagctgagcttagtgtcatctgcctgtagtcccagctacttgggaggctgaggtgggaagatcactgagcccatggaggtcaagactgcagtgtgccctgatggtgccacagcactccggtctgagtgacagggcaagaccctgtctcacaaacaaacaaacaaacacaaaagataaaaaaaaaatctctaggtcagaagcagatgctaaagagatccagtagtcaaaggtgaggggaaatgttagagtgtggtcagggttcatcctgcctgcatgacactgcccatcctgtgctggggatgctggtggctttgggcttgtgtttagatttgcagttggggtcatattccaggtccaatgcattttcccatccctgataagctcagcacgatatgtgacttagctctcagtttctctgaaggagatggccttgcagtttgaactccaggagctcctaggagccactgtggaaaagaggccggagcatgaacaaggagcatctaacttcagcctgacaggacagcagcttgcagtgcagtagttacaacaactccgtagaattaccaagcctgccttgtagtgattggggagggagagttggtccgttgtcacattgttgctgtgactagtccattagctgacctcgggggtgtttctctggctcgtcgaacacagggctgttcagctgttacaaagctcgtgtccaacctaacatcagtgtctctctctgatttccttttgcgagcttgagagctgcctgtgatacactgttggtggtgcttcatggaatttgtcctgtgtgcatgcgagatagttttaattctctttcacaaactattaatgagctcacgtctagggttgctagagtttaggaacaggaatcagatgaggaataatgaatttaaagatatagatagaggactctgagaaaaacagctgagttagtgagtcctatctgtaaagggtatggtttcattctttttttatggccgtgtagtattccatggtgtatatgtaccacattttctttatccagttcaccattggtgggcacctgggttgattccatgtttttgctattgtgagtagtgctgcaaggaacatatgcatacacgtatcttttggtagaattatttattttcctttggatatatacccagtagtgggattgctgggtcgaatggtatttcaactcttagttctttgagcctgctcttcacagtggctgggattatcatacactcccactgacagtgtgtgagctttgctctgtagccttgacagcatttgttgttatttgactttttaaaaaaaccatcgagttggtatctcattgtgcatgagacggtatgtcattgtggttttgatttgcatttccctgatgatgagtgatgttcagcattttttcatatgtttgttggctgcttgtatgtcttcttttgagacatgtctgttcatattctttgtccactttttaatgtggttatttgctttttgcttgtttattttaaattccttgtagattgtggatatcagaccttttgtgaaaaatggacatttttaaagctacaatattttggtttttagcatatccagagagctatgcaacctatatcatgacctaagtttagaatatttttatcacctcagaagagaaacttcaaacctattagcagttattccccgtctaccctgtcccctagctcctgaaaaccactattgttttagtttctatgaatttcctaccaccactccatcatactctgccacccaccaaactaatgccacttccattgctaagcccactaggacactccctaaaacttcaatgcctgaccctcatgcctccgtgtattcctaaatagccatcgctgtagtataaccaaaaacaactatcattccgcgcaactatcattccatataagtggaatcgtacatggtgtcatctttcatggctggcttctttcacacagcgtgatgttttcaaggttcattcatgtagtagcatgtcagtacttcattgctttttatgactgagccatcccattgggtgtatttaccacattttatttatctgttgatcaatggtggacattggggttctttccactttgtggctattatgagtagtgctactatgaatatttgtgtacgtgcttttgtgtggacatgtttttgtttctcttgggtagatatctaagagtggaattcctgagtcatgtggtaactccatgtttaacctgatgaactagagggagaaggttggtaccttgccacgttagaatgacacaaatctctcccaggtggtgagtatagctcccaagtggtgtagctcctgtcctggctaagattcagccattttttttttcttgaataaatactcctcagattcttgtaagcctttggttattttgcagagttctgaggagggtgattttgacagttttgttcgagctgctttaacagaagagcggctttttgggataaatttctcatcctattgcttatttttaaaattactttctttgcttttaagctttaatagtgttacttgaactttgcttctaacagatgcatcatatttcagagataaactcattaaatcacatcatattccccaaaactttgacagaaagttacctaagtcaggataccttggtgactggactttcccctgagattgttttccttcattgcacagtaagttcatattctactgctctccctctctttcttaaatttttctatacttttttgtgtcctctttattgagatacagtatgcattcattcacattctctaatttaagagtgcagtttaatgagctttgaaaaaatgtgtagtcatgtaagcacgattatgatacaaaacaatttcatccttaaaaacagcttccctctatctttttacagtcagtccattcctttacaccccagcccttggaaatcagtgctctgctttctaacactgtggttaagtccctttctagaatttcatataaatggaatcatggagtacctatcatttgggtctggcctccttctcagtacaataccttcaagattcatccgtgttgttgcatgcttatcagtagttcaattctttgttattattatgtagaatttcgttatatggacataactcagcgtgttgatccattcaacagttgatggacatttgggttgtttcctgttcttagctaatttgaataaagctatgaacactcatgcataggcaattctgtgaaaatttttattcttttagcaaaatatttagtagaattactggtcatatgataagtttatgtttaacgttattagaaactggcagattgtgacaaatgatgagtatctttttgtgtatttatttgccacctgtaacttcactgacaaaaggatcacccagctccttgaccagtttattattggacattgccttcctattattgaattgtaagatctctaaatatatactgtcaaataaatgtttttcagatagcttattccaatatgtggcttgctgtcatttctttaacaatcttaatagtgccttttgaagagccgagtcttttaattttcaccaagtctaatttatcaacttttttcttttgtgattttgactgtcatactctatttaagaaagttttgtctcagccaaggtcattaagctttattttgtttgtttctagaaattttgtagttttaatttgcacatttagctctgtaatacagttcatgttaaattttgtagatggtataaagtaaagatcaaggatcatttctgctggtatgtggatgtccagtttgttcatgttatgttgaaatggtgattgtctccatggagttgcttttacttgcacttttattgaaaatgaatttgctactgatggatgggtctgtttctggactctattctgttccattgatctatttgactacctttgcaacattattacagtcttgattactgtaacttttaaaaagacttaaaatcaggtcgtttaagtcttcagattttcttcctctttaaaattgttttggctattctagattacttatgtttcaatataaattttagaataagtttgacgatttctgcagaaaatccacttagaatattaagattgcattaactctatacatcaattttgggagaattggcatgttagtaacattaagtgtatttgcgtgtagatctctttatttaggtattttaaatttttaccaatatcacatattttttaaagtttatcactgagattatatttttaagattattcaaaatgtgttatgaatttttaacttactatttccaattgttagtatacagaaatattatttatttttgtaaattgactttttatcctacaaatttgctgaactgttttattgattttgtagtttttccatacatttcttaggattttctacatagctgttcattttatctgcaaatcaagccagttttacttactaatttctgatttttactgcttttatttccttttcctaccttgttacactggctaggactgccagtaaaatgatgactagaagtgtgagagattaaatctctgcctgggttctagatctaaggggaaaagtgttcagtattcatccattcagtatgttacttgtcagtttctcatagatatcatttggcagatatcttttggcaggttatgagagttcctgggttatggaaaatgccataaatttcctcttagcacttccttgcatgcgttctatgaattttgacgtgtgattatttagtgtttgttcatttcacactcacatttttacacagataagtattgagctaaaggtcccataggactgtgctgcaggtctctagagctcaggtcttctgtgaagcacctcctctccaacaccctgctccataacgtctagctttaccgaactcctggaactctgggctttgtgtcctcagttcattaggccaccaggtcttatctcaatctcctttcttaggctgtggtctggaagctttctctaggcagtgagctggggccctcgtaagctcaaatgtttgtttcctgtctattacagatgactctcttgtactgcctgttgtccaaagtctaaaacacatcattcgtgtatttttcctatgttcttattgtagaaaggagagtaaatctagtccctgttattcctttatgctgagaaacagaaatctgtaggtttactatcacactgatcttgtgtctctgatttcatgaaggaagcgtgcatgagagaaactcccagaggcagatgtgctctaggaggagtgaaggacagaaatggcaagccctaggtagcgcatgaggctgggaccaccattctggggttgatgtttctccatcacacattaggttgacctggggagtgtctaggaaaacactgatgctgttttgcctcacaaacactaagtcaaaatcccaggcaccagtgttctgtgaaagctatgcttgggaaactgacgtgaacctatttgtgtgaagcatggggctagctcctctaagctgattctgacctgtcttatgtgaggtcactgagctggctctgagatgcctaccaatattgaagtatttacagactgaagcaatttaggcagcatgctctagtacttccagtatcttcagacaagctgcaattcttctaaggagctgaggggcaggagggtttgatctcacttggtagtacagtggcagttgggaagtgcccgtggacatgtgctatgttcagaattgtcagaattgtggacagtcactccaggcactaatactgggaactgccaatcaaggcacatggtagcaacttagtaaattgcaactttttttttttttggaatgaatttgatcaggtaatttgttatctctgagcctcagtattgtattagtattgccatgtgtaaaatagtctacttctgttatcttccaggattttgtgaaactcacataaaatagaccacgtgaagacatttaggaatttatttaaaaagagggaggactataaatctacttagtatgttttatgtcttaataatttaatttagtctaaaagtgggttagatgtaacggtgcctttagaaattaggtcttgtgtaaataggcattgttttggtttgaattagttcatagaggaaagtaggtttactttaataaataattgaaaacatattaatacaagtcgcaaaaattttttagtgaaaagtgtggaaagaaaaaaaaactacaataaaacggatatggttttctgctttctcgttgttggtattttatttaagcattcattctttatataaggctcactctccttggcttttcttcctctctgaaataaacagacattagtcacatgcagaattaaacgctgctgcagaattttgtggtgtggcatgagacactcagagctgatggaagtctagaaaggttaagccgttgtccgacctgaatcaagcaattcttttcaaacattcagtaaaatgcggccaagtaggcataatctaaaatggactatgtggaggtcccgtgggcaagattggggaggaattcctgggcagtcttcatccattttctttttcctattatggtaagctaactcacagcttaagtcaatccatgaatccatctctagtcctgggtcaagcaacaggggtgggagtctggtggggaatccggcacttagagtaacgtgttcaccatcgctcgtgtgtgtgtgtgtgtgtgtgtgtgtgtgtgtgtgtgtgtgtgtctaatggtaggatgtttcagtctcttctcgtattgctccagagagagcgctgtggtctcacaagtcttctgaggattcttcctggtggttcagaacagagtgtggactacagaaactttaatgtataatgtgttcaggaaagagtacctgtaatattttgcactgttcatttttagtatagaagctgcaactcttgtcttaatctacatctggttttagaaggcaggagttcttagggaaaggctggtgtagcttcattttggcaattttaaaagttttacccgatgaacccttagccatccttgttagtcctgcagacaaccgtgaacataccacagacaaggtgctcagaagggggacttacctatgcaggtccaatcatctgcaaaggatcgggcacattggagcctgaccgtcttaaaaaagcctttctttatgagaatccgtgggctttttctgtccaaggcaaagcacaaagcacttgttgggcctatttaaggcactgcaggatggcatccttgatggggtgtttcaggtaagccacttgcaccttttgtagtaactttcttatagacagtgggctcattcagtgtgtggcagatgcccggcaagcatgcttcatcttgctctgcagtggcaactctctcgtttcccatgtggaattgtgaccatggagcttcgtattttcagagatttagttcctaatgaataaagtattttaaatgtacttatttatttgtgaccccaaaaaagaagggtttgggttagatgatctctttcagctttcagagcctgcagtccctttcctgattccgaatcataaatgtatgggaatgtgtcaatgtgcaagagaaagaggggaacagaaaaagtcaaatacaaacacaagagtattccagttaacttaagcgagaaaatcttccacaattcctctttcttttggattctctcctgttgtctccaaggctcactgactccaacacagggccctgagggtcggttgcaaagtgcttgaacattctgtcctttgtttcacatctagtctcatttcagggtccgtttgttgacacttgaagtcaagcgctgtgtcatcagagagactctggtgcaaggcagtcagctgtttactttgctgcacaatctctgtgcccagttcagccagagagagcagccctgcatgcagcaaaccagaaccaagcctgcagcaggactcaactaagttgtcactctggagtgtttttctggctggaaatgaagctaatccttcctaatgcgctggcttcttcgaccatgtccaagcgagggctcacatttggctaaggcttcgaatcctgtttcagggaatccaattcaattaattcaatgttcctctttacttagcaaatactaaatacctactacgtaccagccagagcagtaggcactggagtacccatgagacgtaaatctaggtacatagtgggaatcttaaatttgctaggactggggaattcgggtgtatagccaaacaaagaaaatgtagtggaagaaatatcaaatgcaaaaaaagcaagaattcttagtttaaaaaaaaaaaattatttcacttatgaaaggagtcttctgtgaaaccacccctaggtgtaagccctggggatagatcgttagaaacaggaccccccacccacccccacagagtacctgggaacttaagcctacaaagattttctagactctctattagagaaattttaccaaaacagttatgtttcaggaaagtggggatcattttacccagtggccttgcaagtttcacagcaagtctccttgttatgggtctacagggaattaaggcaacttgaactaagagagaaaactatggtatattttctaaaaaaaaaaaagaaaatactgcaatgagagttctattttttttttttacttggtagagtaagtcatacctaaaatttccctgtaagaccttggtcaaaataagaatgttattactttggcttaatatcaaaatggtaaaacatgaactggaagtcaagataatagttttctttacatcttaattgcaaatccttcaagaaaaaaggaaaatatgacaaaagcaatatagcatagacattgaatagagactttgaagtcaaaaagcttgaaatcaaataatggctctagccgtcactcaatgtgaggtcggaggcaacttatgaaacctctcttagcctcagtctttccatgtgtaggatggggatgataatatctatttcacatggttattattacaattaaatgagtggctaattgaaaagctctttaacaagtgcctggcatgtagaaaatgctcagtaaatttcatttactatcattcttgttgctactgttactgttattattacctgcagtgtgtgaggtcttaggctgtgcttggacttggacatgaactgggaagggtgaaggggagggtgaactgcaaacctgagtaagggtgaaggagagggtgtactgcaaacctgtaataaaagaagtctgtattgaaagaaaaagaagccaggatccccagagatacaggggagagtgtagaatgtgagggaaccagcaaacccagtgttctctagtcttaaacactgaaacgtctgagacagctttatacatctccttgggcgcatttctctaacagacaacagtgtggaaatctgatccagctaacaacagaaacacgaagaaccaactgcataccactccatcaagagccaaccctggtttaaagtaaagcttcctgtggtgtttcagtcttattatccctccagggatccagaagtcatcatgaagatatttcgctaaaactgcactcgtacgtttaaacactgataatggaaaaatgtattttgccaaaaacagtaagaactgcaacttctattgaaacatactgagaaatagtgttatagtgaaagtcaaagatctgatgttgaatcaggttgggagggcaagaaatgattttcatgaagaaggaagaaaatgaatattttcaaaagctcacctgcctggaagtcacaatgaagcattaaggaacatctgacataaaaggagggagtgtaattcatcaagaggatgcccatggggacttgattgctggactttatttctaagtcaggggaggcatgatcctaagcattctgaagagatggaagggacatcggggctgccactgggcccctccctcacacctcatgctccaccaggagagctcagccttgccacgcggctctgtggcctgggacctcagggtcggggtgagccgtggtcctgctcaggggatagcaccctctgctctgctgtgcacggtagccccacttttcattctgcacacttcttctaagctgcaggagctcctggctctttttcatgtcaccaaagagccttaaatacagaaatcttcatgttttctttcttttttttctctttaggagtctctagactcctcttggcccaaaggttaacatggtaggtggcatttgcattaagtaggtaccaataggggtgtgtgtgtgtgtgtgtgtgtgttgacctttgctttgatcagcttttattacaaaatttgaccatgactacgtttgtgtgcaagagatgccgctggaagtatagtcccaggctgggaagctgctacctagcagcaaagttacactagggaagaggaggtgcacagctgtggctgacagcagcggcctttgccacaatcagtactgggcttcagtggtctttctccctctattatatcacatttattataacagctttatgtgcatgtgtctctaggtcaccagctccttatgagaagtacccgagctgtttatctttctttctccaggccccagcctcattctttctttttgtcctgattttactttttttattatactttaagttctgggatacatgttgcagaatgtgcagtttgttatgtaggtatacatgtgccatggtggtttgcttcacccatcaacccgtcatctacattaggtatttctcctaatgctatccctccccttgtcccccacccccgacagaccccagtgtgtgatgttcccctcactgtgcccatttgttctcattgttcaactcccacctatgagtgagaacacatggtgtttggttttctgttcctgtttgtttgctgagaatgatggtttccagcttcatccatgtccctgaaaaggacacgaactcattctttttatggctgcatagtattccatggtgtatatgtgccacattttctttatccagtctgtcattgatgggcatttgggttggttccaagtctttgctattgtgaatagtgccacaataaatatacgtgtgcatgtgtctttataatggaatgatttataatcctttgggtatatacccagtaatgggattgctgggtcaagtgatatttctagttctagatccttaaggaaccaccacactgtcttccacaatggttgaactaatttatactcccaccaacagtgtaaaagcgttcttatttccccacatcctctccagcatctgttgtttcctgactttttaatgatcgccattttaactggtgtgagatggtatctcattgtggttttgatttgtatttctctaatgaccagtgatggtgagatttttttcatatgtttgttggctgcataaatgtcttcgtttgaaaagtgtctgttcatatcctttgcccactttttgatggggttgtttttttcttgtaaatttgtttaggttccttgtagattctggatattagccctttgtcagatggatagattgcaaaaattttctccctgttcactctgatggtagttgttttttgttttgctttgttttgtttttgctgtgcagaagctctttaattagatcccatttgtcaattttggcttttgttgcaattgcttttggcgttttagtcaggaagactttgcccatgactatgtcatgaatggtattgcctaggttttcttctagggtttttatggttttaggtcttacatttaaatctttatcttaagttaatttttgtataaagtgtaaggaaaacgtccagtttcagttttctgcatatggctagacagttttcccaacaccatttattaaataggtaatcgtttccccattgcttgtttttgttaggtttgtcaaagatcagatggttgtagttgtgcagtgttacttctgaggcctctgttctgcttcattggttgatatatctgttttggtaacagtaccgtgctgttttggttactgtagccttatagtttgaagtcaggtaccatgatgcctccagctttattctttttgcttaggattgtcttggctatatgggctcttttttcggttccatatgaaatttaaagtagttttttctaattctgtgaagaaagtcagtggtagcttgatggggatggcattgaatctataaattactttgggcagtatggccattttcacaatattgattcttcttatccatgactatggaatgtttttccatttgtttgtgtcctctcttatttccttgagaagtggtttgtagttctccttgaagaggtccttcacaccccttgtcagttggattcctaggtattttattctctttgaagcaattgtgaatgggagttcactcatgatttggctctctgtttgtctattattggtgtataggaatgcttgtgcatttttgcacattgatttttgtatcctgagactttgctgaagttgcttatcagcttaaggagtttttgggctgaggcaatgggattttctaaatatacagtcatgtcatctgcaaacagataatttgacttcctctcttcctaattgaatatgctttatttctttctcttgcctgattgccctggcaagaactcccaatactatgttgaataggagtggtgagagagggcatccttgtcttgtgccagttttcaaagggaatgtttccagcttttgcccattcagtgtgatattggctgtgggtttgtcataaatagctcttattattttgagatacgtcccatcaatacctagtttattgagtgtttttagcatgagggggtgttgaattttatcaaaggccttttctgcatctattgagataatcatgtggtttttgtcactgattctgtttatgtgatgtattatgtttattgatttgcatgtgttgaaccacccttacatcccagagttgaagccgagttgatcatggtggataagctttttgatctgctgctgtattcagtttgccagtattttattgaggatttttgcatcaatgttcatcagggatattggcctgaaattttcttttttagttgtgtctctgctaggttttggtatcaggatgatgctggcctcaaaaatgagttagggaggattccctctttttctattgtttggaatagttttagaaggaatggtaccagctcctctttgtacctctggtagaatttggctgtgaatccgtctggtcctgggcttttttttggttggtaggctattaattactgtatcaatttccgaacttgttattagtctattcagggatttgacttcttcgtggtttagtcttgggagggtgtatgtgtccaggaatttatccatttcttccagattttctagtttatttgcatagaggtgtttataatattctctgatggtagtgtgtattttgtgtgggatcagtgttgatatcccctttatcattttctattgtgtctatttgattcttttttcttttcttctttattagtctggttagtggtctatctattttgttaatcttttaaaaaaaaccagctcctggattcattgatttttgaagggttttttgtgtgtctatctccttcagttctgctctgatcttaattatttactgtcttctgctagcttttgaatgtatttgctcttgcttttctagttcttttgattgtgaagttagggtgtcaaccttagacctttcttgctttctcatgtgggtgtttagtgccataaatgtccgtctaaatactgctttagctttgtcccagggattctggtacattgtgcctttgttctcattggtttcaaagaacttacttatttctgccttaatttcattatttacccagtagtcattcaggagcaggttgttcagtttccatgtagttgtgcagttttgagtgagtgtcttaatcctgagttctaatttgattgtgccgtggtctgagagactgttcgctttaatttccgttcttttgcatttgctgaggagcgttttactccaattatgtggtcaattttagaataagtgctatgtagtgctgagaagaatgtatattctgttgatttggggtggagagttctgtagatgcctattaagtccacttggtccagagctgagttcaagtcctgaatatccttgttaattttatgtctccttcatctgtctaatattgacagtgagatgttgaagtatcccactattattgtgtgggagtctaagtctctttgtagttctctaagaacttgctttatgaatctgggtgctcctgtattgggtgcatacatatttaggatagttagctcttcttgttgcattgatccctttaccattatgtaatgcccttccttgtcttttttgacttttattggtttaaagtctgttttatcagagactactgcaagccctgctttttttactttctatttacttggttaattttcctccatccctttattttaagcctatgtgtgtctctgcatgtgaagtgggtctcctgaatacagcataccagtgggtcttgactctttatccaatttgccagtttgtatcttttaattggggcatttagtgcatttacatttaaggttaatactgttatgtgtgaatttgatcctgttgttatgatggtagctggttactttgctcattagttgatgcagtttcttcatagtgtcgatggtctttacattttggtatgtttttgcagtggctgttactagttttccctttccatatttagtgcttccttgaggagctcttttagggaaggcctggtggtgacaaaatctctcagcatttgcttgtctgtaaaggattttatttctcctttgcttacaaagcttagtttggcaggatatgaaattctgggttgaatttttttttttttaagaatgttgactattggcccccactctcttctggcttgtagggtttctgcagagagatccgctgttagtctgatgggctttcctttgtaggtaacctgacctttctctctggctgcccttaacattttttccttcatttcaaccttggtgaatctgacgattatgtatcttggggttgcccttcttgaggagtatctttgtggtgttctctgtatttcctgaatttgaatgttggcctgccttgctaggttggggaagttcttctggataatatcctgaagtgtgttttccaacttggttccattcttcctgtcactttcaggtacaccaatcaaacgtatgtttggtctttccacatagtcccatatttcttggaggttttgttcgtttcttttcattcttttttctctaatcttgtcttcattctttatttcattaagttgatcttcaatctctgataccccttcttctgcttgattgcttcagctattgatacttgtatatgcttcacaaagttcttgtgctgtgtttttcagctccatcaggtcatttatgttcttctctaaactggttattctagttagcagttcctataactttttatcaaagttcttagcttccttgcattgggttagaacatgctcctttagctcagaggattttgttattatccaccttctgaagcctactgtcaatttgtcaaactcattctccatccagttttgttcccttgctggtgaggagttgtgatcctttggaggagaagaggaattccggtttttggaattttcagccttttcgcgctggtttttcctcctcttcatggatttctctacctttggtatttgatgttggtgaccttcagttggggtttttgcgttgtcgtcctttttgtttatgtcgatgctattcctttctgtttgttagtttttcttctaacagtcagtcacctcttctgcaggtctgctggagtttgctggaggtccactccagaccctgtttgcctgggtatcaccagtgaaggctgcagaacagcaaagattgctgcctgcttcttcttctggaagcttggtcccagaggggcacccaccagatgccagtcagagctctcctgtatgaggtgtctatcgacctctgctgggaggtgtctccccgtcaggaggtacgggggtgagggacccacttgatgaggcagtctgtcccttagcagagcttgagcgctgtgctgggagatccactgctgtcttcagagccagcaggcaggaacgtttaattctgctgaagctgcgcccacagccgccccttcccaaaggtgctgtgtctcagggagatgggagttttatctatatgcccctgactggggctgctgcctttctttcagagatgccctgcccagagagaaggaatctagagaggcagtctggctgcagtggcttggccgtgctgccatgggctccgcccagtctgagcttccctgtggctttgtttacactgtgaggggaaaaccacgtactcaagcctcagtaatggcgatcacccctcccctgaccaagcttgagcatcccaggtcaacttcagacggctgtgctggcagccagaactttaagccagtagatcttagcttattgggctccatggagatgggctccgctgagcaagaccacttggctccctggcctcagcctcctttccaggtgagtgaacagttctgtctcactggtgttccaggaagcactggggtatgataaaaaactcctccagctagcttggtgtctgcccaaatggccacccagttttgtgcttgaaagccagggacctggtgatataggcacccaagggaatctcctggtctgtgggttgtgaagaccgtgggaaaagcctagtattgggctggatagcattgtccctcacggcacagtccctcatggcttcccttggccaggggagggagttccgtgaccccttgtgcttcctgagtgaggtgatgccccaccctgcttctgctcaccctccatgggctgcacccactgtctaaccagtcccagtgagacggactgtgtacctcagttggaaatgcagaaatcacccaccttctgcattggtctcgctgggagctgcagatcggagctgttcctatttggccattttggccaggaatcctccttacagatgctgtttattctaacaaccattctgtccataacacacacacacacacacacacacacacacacacacacacacacacacacgtgtcacaagtgaaattttgggcaagtcattagatgtctttgaatatcactcacacagcaaatttgtgggtatcccaggattagaaacaatttatctcaattgttaggtcagagctatttctccttatgtctgtgatttctatctaatgtgtatattaatataagaatttcagaaattatgcagtaatttaaaagttcaagaaacctttattgcaaacacctccttctgcatttcacaggagggcctaaagaaaaactttttcatagaaacatgtacacaagacaatattaccagaaatcaacccccaaaatgaaggcatcagggggcacgaagaagagacttaacaaactttttttcttcccttgcaaattctggtatcctaagaagcagtctgaatgatttgtgcatgaaactgccttggagcaggtgcaacttcagggggaattctcttatttttattgcataaaaaatgaatcctatggaaatacagactcctgttctgctgagttttgcattcgcatagctgaattaggagagggagatccagacagtacagtgtactgataccatttgaaatatccccacttgttcttcatgaattcccccatgaggttgtcatcatttaattcaatttaatctttaaaattcaaactcttttgaaactttttatatgtggagtgctctgatctcatttttggcttctatgacacttttcccttaaaagcaaagctgtgatctgtggcgaggaagtttgagtggtgcatcttccagtctcatctctgccatttgttccagtgtctaggaggaaagaatctttgcactatgcatattcagtgcactagggataaagtggccaatgtgtcttcattccccaagctagaatggtccttcatttatcggccagcctttgctgaacacacaggtcctgccattcactgtacaagggaaagatagagattaagatccaggcaggtccctgctcgcagtgctgactgagtactgtacctatttgcccatgtgatgtgtctttctattttccaatgagagtggaggtccatgttttaagactactttgcctcccattgactgaggattgggattagatctttgattgggctagagggagaggtgagacactttgaaggggtacagaaataatctgtggagggagaggaatcaagagggactggacaaagttgtgtctttatcttctggtccccagattcaccactcccctaagagcaacagcactagctcacagctttagcatgacatcctctgtagctttactcacagtgggaccagttctgtcacagtaggaagaaattctgtcaaggactaatgtcattgctccccgggtggcccaaggcatccccagctgatcatgtgaccagccagcctcccattcttccaggtcagagagaaatgatctacttttttatcttggtgtggtggatgggactaaggaaagaaagagttggggtttgtcatattatttctttactttgtactcagtagattatattgacaggcattgagtaaatccagtggaaacatgaactctccatactgtagtagacattgaataatttgagcagaataacagagagaaaaggaaaatgactaaataacattttaggaaataagctacatttcctagacgtgggatttggcaatttgggatggatggagaaatgaactttgtgtatctctctgaaacaggtgaaattgacattctggaacaaaaatctaactatgaaaaagaaaactctttatttcaaatctatacttgggcaacagtttggggccaggaggaataaaagaccttaacaggtcctctgtagccctctctgacttctaggcgtctgagtaatcacagacacccacacattgttttaaaaccctccagagagagaaagggagaaaaaatgtctttgataagatcaggtgcgttcagggtcgtatggctgtagacagaaaaatgtttttgtttccactggttacacattctgatgtccgacctacatcccttctgatgaaattcaaaccaaacccttttctttcccagtccccattggaaacagaaaatagatatgcatttttcacactttaaagaactcatcatgtaaaaaaattgctttttaacacatttcatgccatcatgtcttccttggaaattttcagtgcctttttttctatttgtctaagtagagaagctatctttctattttttttatggcttcttctgaactcctaccgagacctgttcatctcacatcttcaggccccaaattggatacacaatttttaattaagatgtgatccagcgaagtatttgcttagatcttacagatctggaaaaaaatgcccttaagaaaagactaggcaaatagaaataatataatctccttgcctcagtccaaacttgaaggactcattagaggatgcatgcaagtagggaccagaggaccatgaaaatcctgctgggattgagcgtgatttctgctgagatcactgagatgccacaacattgaatgctgaaagttttagcaggaatcgttggtgaacttttcctttggaattccgcaagtgcttcttgttacaggcatagacaaatgtatactaaaaattacatgtataatttaaatttcagcaagaaatactgttgacttcttatgaggaaaaccaggcaagtgatttgtaaactcttgaagcaagaaatgttgatgtcttctccatctctttatcctgtagagcacgttgcactgagatggccccagaagtagatactgagaaagttctagttgaatcatttaatttgaatgaagctgtgagataaaaggaaaaaaaagaggctacttataaaataaatttatagtatggtcacattatccagagtaaggttagttcggtttggtttgaattgtttcatttttagccaggcacagactgctcagaaagtaagcatttaaaaatttgtcgagatgttatttattatttggtaaaagttgcaatgcaccaagatgtaagattttacacccctgagttttatggcatcacccttgctaatttattcatgattaaaccaaagaactctcaatgaggagaagtagattgcaatataaattggtgtcattgtttgtaaatgtgctccactaagcatatatactgctccactaagacagcttctagtaccatgcctggggcttcaatgcaatttgcttacgttgaatcactggctcccagactccccttgtgaactgaacaggcttagaaaatcattctaaagaatgcatggtttgtgtagttgtagaacgaaacttctcttggaagcttattccccctcaccagggaaggagttagtgggagattctcaatctggtctgcagatgagtgccttctaggtaattcacacatataatttacagaagtgggaagaaatgaattcaaaccatttttttttttccctcagaaaactaaatgtcaatctcattccatttccgttggacggggaaattgacgtaggagcagcgtgaggtagagtggcatgctgaccataactagggtcagtcaccatcggaggacccagcagagagctgtggggtgctgcagctggggaggactttctccatctgtttccccttggtaccattgatttgttgtctgatttaaatatagagttcagtatgcaggtgtgtaagtgcagcataaataaaatggcatcctccttcacagccaaggggccttcgtctgggaaactgatataatttatgagagcgaggcagcagcataaatacgtggggtgctttgtcaccggccagtatggaattggtcagcttggaggaggggaaacagagtcagggggaagacagcatgccaggaggagctaaattggggcaccaggacctgaaccctggaagccagtccctaaacaaccagagctgctcagcaactgctctctaattaccctttgtccctggagaattccagaggggatgggattgcctcagtgaacttaatcttagatgggtggctgtcctccttctttttttcccttgacggaggagggagggagggcgtcgagggtgatgcatcaaactgagggtgacaagaagctggcgccttttgctccacttcccagccaggagggctgacagtgctggagtggaccagtccgcggagctccgggggtctgaatgctccaggggtgtgtggatggcaatggccaggatggccctcctggttgcgacccatcagaaagtggataccactgtcctctggtttgcctgctgtgctggtaaggtgtggtgacgtgtgtgtgcctgtgtgtgtgcaaagggcaaagagatggacagtgttaccattattcatttggaattagaattgtggaggcttgcacatttgtttgtcttccaagttctggcctcacccacccttttttgagggagagaggggccaggaaggaggccgttcccagccccatgagtcaaggagggcatcgggggatgctcccactgaggaagctcagagcggggcccggagaaaggggtgctccaagcggtgcttcctggtcgatggcacgtcggggtgggcaggctggagttgaagagcttctcagcgtggataggaaatcatggaaatgaggaatgatctagcctccagcagtgagtcggaggaataaatgaatcccggaaatgcagtttctgtgaactccagattgctatggagattgcattgctttcccaagacttaaaaaacgaagagtcagcgaaagctgggagagcggtgatgtatggaagtcaggcgggccagcgcgccgggagtggtgggaagggggcttcgcaggtcattacacggggatttctccgcgcagaaaaagggattagcgttttcacctggtggggatttcatgagcttttccctggcctgctcttcccctgccctttcccagagagcccagcttcagggacagcgcccgcgaggtgctgctggggtggcggggcttgtgggcggaggagggcggctctctggtgtgcagcaccgggtgtgagtgtgggtgagcgtgtgcgggagagggtgtgagtgtgagtgggtgggtgggtgtgaaaatgggagaaagtgtgagcgtgtcacagtgtgtgtcactgagtgggcgagtgagaaagtgggtgaatgtgtgcgtgactgtgcaagtgtgtgagtgtggggagtaagatttgtgtgagtgtgagtgtgcaagtgtgtgagtgtgggggagtgagtatggggaggagtgagagttgtgtgattgtgtgtacacacacgtgtgcacacagggcgggccgcgcttggcatttgaggaggggctcggaggtcctcctgggctggccgctgtcctgggagcagggcaccagggcaccctgcgagttttcaccttgccaaggtatgccagaagccggactccagcttccttgccaacgtgtgcgggaagcaggaccccagctgcggtccagggaggaaaaggggggtgctcacagctggggcgagtccctggagcccacaggcagtgacttgccccagaatgagcttgagagagtctggggatggagaacactggggatgcttggtgtggtgcagaggtaggaggatgtggatgcctgtgaggtactggtgcgaggtttgccacgtgttatccctgcatgagagagcgtggaccactgttttaggccaggatagggacagcatgtccaattacacagggctctgcccacctgcaagatgcaaggaggccctgtctccaatgtcccctgacctgacagtcctgccacctgccagcctcgcagtggccagccccgcccccagcaagccccacccctaagagccacacccccaacagctcacccccctgccagccttgccctcagtcctgccccctgccggccttgcctctgccagccagagccagtcccccagcaagccccgccccctgctggctctggcccttctaagccccaccctcaggcagtcccgccccctgccagccccaccactgatcatccccgccctcagacagttttgccccttgccagctggaggtgggcctcctccagccagagtgaatctcttagtaagccccaccctcttccagccccaccctcaggcagccccacctgcttccagccttgctgaacagtcccgcccctgccacccacatgggttcctgggtcttgcccctgactaccagggtgaccccaatgcctccgagacatccttctgccctagaacagccaggagagcagagagaacaatttaaatgctcagaaagacaactctttcttactgtttttgctttgcccagggaattgcaatcagtttcaatacacagttaataaaatgagaggcattcagcgtggatgtgggtgtcaagggagagggctcaggcttgcttttgccttttagtaccagttcctattgtttggaaaacacgaggtggcttccgagaacaggtcttggccctcgcctgccctggagccccctgtccaagggccgccgtgcctcacaggcaggtgcattgctcttgttttaatggtggccttcatggcagtgggacccctccctccatgactgtccccaggtattgcctatggtgttatagtgtgggggcctcagggaagggtaggtgacctgtccacatttaacataattgtaaagctcattgaagaaaagaggacgaaggagtgacgtccaagtttattgagctttaggaagagaacggccagatttcgttttgagattttctcttatttgctggaagtctgttcaaatcatatgtctcttctgggttattaaacggtcaaggttgtttctggatccccacaaaaatgtgaggatacaaagtccccttgggatgtgcagtggtacccatagtcctcgtggttagaggataaaggggtccctagaatgatggagtaataagggcaaggtgtttggaagcaaatgccgagaagaaatgctcccttatgccgtaaaggccaggagactgtggtcgtcaggctgagtggatggatgggaaaggaggaagtaaagagcacacaccggcttttggaagcagatagctcatagcatttgaagagggcattgccatgactctggcctgcctctctcattggggaatcaaatattaaaaaaaaaatacttatatatcttttagagtgatcttctttggtaatttttagtatataaaaaagaaaaatagggaagaaaccttcaagtttctacttacatttcctgaattaaatagtttacatccatagaagaaaataaatattcatgcaaagctatacaaattcctttgtaggtttttagtaactattctaacagaaatgtatttgtagctaaaaaatgaagtgttaagcatgttttaaaaacggagcattgattttctacagcagggatatttagagtcttctttcccctggttacactcatgtgcatttgcttaaatccagtggcctctggctgcacctgcctttgcatcatgactttgtccaatcctgcatgtgttaatttagggcccaagggaccagtctggagcacgcagccatcctgagtaattcacagtccattagacagcggtctgtggggtatgtgctgagtccacacactgatgttccaggaggttcttgcaacttccccaccttgcagctgcctctccagcaccttactctcagtccttccccacaactactctccatctttaacttattacactccctgtcttagtccctttgtgttgctataataaaatacctgagtctggataatttataaagcacagaaatttgttttctctcagtcctggggtctggaaagtctgaggtcgaagtgctggcatctggcaagggccatcttgctgtgtcctccatggcagaaggtggaagagaacgaaccttctcctgcaaccccatttttttaatacattaaatgcatttataagggtggagcctcatgatttgaacacctcccaaaaggccccaccccccaaacactgttgcattggggattaagtttccagcacataaattttggggggcacattcagaccatagtacctcccaaatctataaggccacctctactttgctctcagctctatctgttcatttgcaattgtcttttaaaccccacttaaatgtcctatcacattttatcaacaataacttacttcactgggcttccttacacacactagttcctattcctgacttctgatttttattaatatccctgttcttctagttatccatctttgacacttataatatctctttcatttactacatatagtaaagtgaccacattttgacaattctttctccagtgtaagtgtggtgtcctataactaatgcccttttcttcctatagccatcacttgcatcctccatgattggaacagtcccctggtgtgccccacacctgctgttctcctctccagcatctaatccgtcctacccactgccatcagatcactatggagagcccaggcctaatcatgtcaattccaggctatcagatgttcattgtcagtttaatcacagaattggctgaagtcctttatgctctaattattccatcatcctcaccctcttctcctacatgcaattgacactatgactaaatggggtacttgctcttcctccaaaaaagctctaaacgtttttgtttccttgcttctgtaaggcagttcctcaccctataaggggcccattctgtccctgaaattctcatccctcatatttatctcttgaaatactgtccattatttaaaatacaggtcccataccttctttttcacaagattttccaattttcttaacttgaagtcatagctctctccccctacctcctccttccccggtatacttggtaattctatattcacattattcacacacatgcatccaaacatttttcttatccttctactaaatatgaaatatcataagtagaagccactcctgcttcacggcagcagtctcctacataaccacagagtttagacttcactaaaatgtaagctttgtttttgtcaaggttgtatctgaatcagtgtctatatcagggcctgtaacctagcaggggtttcaagagtgctgatgcaatgaacagatgaatgaactcttgtgaagcaatagatctagcacccagattgatcccgtcttcttacaaacacatctttaggctgtccccctgtgtcttcttcaaagttgacactgatattcgtttaaattttatttcacctgaataaaaaaatatagtgtgagaatgatctgctgagagcccagctctccttaaaaaactctgcctcaaagatactttaaattatattcttgatgaaatttgtattcttcgtgatgtatcaacctcggcagcaaatgacaacaaaccacagctggttactgtttgaacccaaggttgtaaaccaaagagtgtgtgtgcatttctccccaccctaccccatacaacctacttcatcctcatgcatgtgtagataacaggtcaaccaaggctagaaatcataatgggtgtgagttctggttccagagttatatcacctcaatgatcttattcatttcattcctctacccttgcttgagtaaagctaatcattttctcatcttccccagatctctttggggttctaaaccaagctgaaaagtagaccacagttaatacgccctctttcccagccacccagtacatctcctgtctttagccagggaagcacctgtatgccccaattctggccaatcttggctaaggtgccaactctaacgattctagaagctgttggttaagtgtgttgcctgatcagggatacttccttacaatgagggagttatgaagaagctattggatcaataagctaatattatagaattacactatccagtactagatctggaagcaaccttataggtacatattctaactccttttataagtgaattaagtgacctctctggttgagtgatataagatctagtccaggctgtgccactaactcccaattcatgtgtatttcaccataccatctgcctttcctctagagtctccaaagaacaaagctacaatgagggaataaaaaagtagaattcacaatgttaagaaggcagttctctcaaaccataccacgtaacagcaactcctctgcctagccatggtgccaaccccatcaattttcaataaaacttcacctgtaatattcaaggagtagtggagtacgtgataatgcactagatttaaagttacccaagggctaatttttaaaaaatcatttttcatatccaatattaaattggttgttagttcttttctatatgtctgtgataacctttgtgccctggttagcagggtctagaaagagccatccatctcaacaacagtggatttagacttgcaggaaacatacagcttgagtgatttggctgtatctttaatgattcctgaacatctgccagaaagaagttgctcatttcaagtaagtcagtgatttaaacttatttttctgttttgtttctttctattaaaagtttctcctaaaattttaatttcatgagaaattctgattagttgggaagtaattttttttagttataatacaagtcaaaattaatattgacttaaggtataaattaagtttactcttgtagtgcctatgaaagactaaaattatgctgttcataaaatgtccctacagataagtttcacttaactggttttagaagatgcttttgggcctttttatttgccctaagcagacatttggactcccttaggtgaaatatgctccagcattagactgctttatttactttgagtttgtcttctcaatatgtgatttttagaaacttcaaaagtacaatgtcttttacatttataagtaaataattgagggaccagcctgcctggagcaaaggaatcagaaaacaagaaatctcagaatgactggtgacatggagtctgtgcttcactgcagttgctagaagtaaaccacagattgagctctgagcttcctaatagccatggcaaggagggaaagccattgaggtgctattcacagtagccactgataaaaacaaagcagccattcactagccatttcctgctagtgaaacataaggacagtttatcccatgagttcttttaagaaggaatgaagggctgggcgcggtggcttatgcctgtaatcccagcactttgggaggccgaggcgggtggatcacaaggtcaggaggtcgagaccatcctggctaacacggtgaaaccccgtctctactaaaaatacaaaaaattagccaggggtggtggcggatgcctgtagtctcagctacttggagagaggctgaggcaggagaatggcgtgaacccaggaggcagagcttgcagtaagcggagatagcaccactgcagtatggcccaggtgaaagagtgagactccgtctcaaaaaaaaaaaaaaaaaaaagaatgaagaaggcagatgcaatgtgacagagatttactagatgatgtgctcgataacacccttcaactagaaaaaaaaattagcttctcttagaatgtgctatcggcatatattggcatacagtaattaagtgtaattgagaaaaggtaattctgagagggaataaaagcaccagatgggagatacggcattcactcttacctaagtcctacctaccttcaagacctggatgaaacatcacttcctccaaggagtcgttgacagacttaggccacagtgatcattgctgcttccaaacatctatggcatttgttgaccaagctatttatgttatactataaggaagcgttgacaaaaacgtggcagttttggtatctgggcaacattccgcaggggctaggattgtgtcatttattgtagtaaatccaatgtctcattcatttcctgtcacccagtaggccctcaggtttgttgccatggatgagttaacagatggcactgactcttggtggcactggagactgcagccatcagatgatgtttcaagagacactccactgtgatgacacatcctgaagacagggaaactaatgtcctttgagaagtacaaatgtctatttttatttcacgtagtattggcttgaaaagatacaaattcacttaggatgaaataaaagtgttctgtatttgaactttatttcaaattattatttcttggaggtttttattaggcaaccagttcctcctgtcttagaaagatgtagggacggagaagttctaaaaattctgggcctatccttcaaggttcaatctcatagtttcttcctcaggaaaacctcctctggccatcctagcagatagacatggcacttccatgtctgtccaattcccccaaaacatgacctaaggctcatctggaataagcaatcttcttctgtgtaaatattttataactatagcctattataaactatttgtttagaaaaaagactggaaaagtacacaccagaatgtagggtgtgtattttcccttcaaactcatttacctttgcagccctcttgaataatgtccttccaagccttttgaataacttttatgttgttgaatatttaaatcgtctccaatagtggtaatttttacagtctacaaacaacaaaaggtaattcaatgtcaagaacaattaataagatagatattcagagtggttgatatggtgagatgaggtttggtttccaaaaaatggttgttctaaaaggaaaccaatcatgtctatgtatgttatatgaatgttgagctctgtttggagttacccccatcatgaaggtgccctcaaccatagcagtgtcactaaaataaatgacaaggcaattttttggaaggtaatattgtctctgaattaaaaaaatggaaaatctttatgcctctctctctctctctctctccatccaatgacactaatgactacttcaggatgtctgaatattgtacttgcttatatatgttcactgcaaccaccatggcaatgaaacatgacaggtcctatagtggaaatcatggcgtggtcctccaaggttaaattggagggaaaccccaccatgaaatgcagtggctagatgctagatcttcactccactccccactcaccagcactgcttctggctttgggattgagcttccttctgggtgaagctcagaagagctcaaacttttctgagccaaggtcaagctgggaaccttgttacgctattttatttttaaatattcacttcccattatgtctgagtcttcagccacatcttgtttatctggtgaacgagtaaataacacacagtttctatgtcagtttcattcatcccatgttttattgagcacctgctgtaagccaggcattcacctggtgatcacttaaggcccatctccttgcttccagcttgcttccctataatagaggatttttttattctctttgagtatgagtgcacagcacacacacacacacacacacacctgttttgtattcaaactgagaatgctcatttatacacagctctcctcttaagcacacaaaaattaaggcatccaacaatcagataaggcaaatgcatttatcaagcatccagcgacaaaaagctcctagacgtctactacatgcagcactgctgttcgggtgctggggttatagcaggctacaagggaggcaggtctgcgttcatgccacctacattttaataagaggagaaaagaatagagaagcactgggcagctgctgaggagtgctaaggagaaaaatcaagggaggaacaaagagtgatgaggagtgttgatttcagaagtgagatcatggaaggtcgccctgttgaagggacatgtgaaagagaacctgaagaaaggtccagcaccatcaggatgtctccacgaaggtgacagtgtcttgtctaggtctgccttgccaccgagtcaccgactgtgagaattggaaggaatatcagcatccttcatttaacagttaggaaaataagaccaaaaagaggttacagtccaagttcagcttcacaaagacgtatctctagatagaagggaaaaaaaggagagcaagaaaatgttaaaagttgactatgcttagaaactgccaaaaatatttaacaaaatgtgccagaactagctgaaaaataagttcctgaatattcaatcaaatattctatatttaatttcatggtataagaatgcagtaatcgaataaatccttgctcttctcagcaaccacttacattgttttataaagttgatccacatcctatctttaggttgtagaaaaggatgctgggggagctgtcatcccagacccttaaatgtagttaatcccctggtaccaagcaaagctcagaatcttcaggacatctgcctctactaccttatgctagaccttagtatctagggagaatgacagcaacatcgtggtcatggttctgaggaaagcagtggaatgcacatcagaggaaaccaactaaacactcacctgtaatgagatgggaagtgattacactatttttcttcatggtatttatagttttaaggaacagctccctgtaagtgacatctacccactgccctttatcctcctattaaagcttttgtaacagatggtgtttatagaattggctactctgactgttagcactgtgaagacatgagtctatgaagaatgtaccccaattttcattacaccccagactaaagtgctaagtagtgatcttttgaatgaatggaatcccattgatagagagtcaattatgcctttgcattaacacacatcatcttttgttcattaactcagaaactagagtgagctggcagcctgagagccaaagagcttctgtgagactctcaagtgacttaacgtggctggccgatgactgattccttccaggtgaagcgctaagccccatcatgcccctgttcagctatggcagggttccaagtgggcagcccagctctcctctgggaggagcattgggcaccacttgagttgagtttgtccaggacctgagctgtattgttctgtgatgtgggacaatcttctcgagcagtatcaatgcttctgagtcacaagggtcaaaagagagttatttccctggggctacaactttctgagtttgcacaacttccagatgcagaattaatttcctgaggtcatctgcagcatggtgcagataggtcacttaccctgcaagcagtatggaaacctgatatctagaattgttgactattctgtgaaacttgtttctcatatcttatttcttcataatatcttgccccatcacatcttcaaggctttgtttgaccttatgggcactgagtaactttttccttttctgaatgcatttggcgtttactgttgaaatctatggcttctttagtgagtacttgccgagtgctcactgtgttcctttgaatggaggtagagtcctatgaaggataagtccttaaggcaggggctatttttatagtttagtatctatctttaacttcagtttggctggagaactaagatacattaaaagaaacttggcagtggggggtggctcacgcctataatcccagcattttgggagaccaaggcaagtggatcgcctgagctcaagagtttgagactagcctgggcaacatggtgagatgctgtctctattaaaaatataaaaattagctgggcatggtggtatgtgcctgttgtcccagctaatttggagggtgaggtggtaggattgcttgagcccggggagggggaggttacagtgagccaagatcgcaccactgcactccagcctgggtgacaaagtgagacccccatctcaaagaaagaaagaaagaaagaaaaaaaaaactcaagctcctcaaaggtggaaaatttatatataagatagctggaaaaataagactaagtaaatttgctttgtaatgtttacaataccgtatgtgtttagtgtctggatgaagaatgaataggttccgggcatgataatattttctttgagcacaaatatgttttatgattgtcagaaccagtgtggaaaattactaaagaaactaaatattcttttgcaaatgcacagtattttgacattttcatttcaaatcaagatgctggaataaggattcccccaaaacctgtaaaactcagcgcagatcccagcaatagatggggttgtgtgtccttgctagctcattgcggattgggggccagctgcactgaggatggccttagctccctgtctgctgagagcaggatgaaatcaatgactgactgatgtctcctaagtgcctgatatatggttgctgatgcagagaggttctggtgacagcccacactgagggatgcttatggagggcccaagtaggcgagagaatgcaccctgcgtatgtatgtggaagccaaggatccagctggcaagttggcaccagccaggctgagtacagaggttccagtctctacatcagaagagccgagtttcctgacctagagaagttattttggctttcaagttttcatctttaataagaagggtttggaataaaagaaggaatactgacaatagctgacgtttcctggatacttatgggtgccagctgctcttcttcgcgtattcatctgtgcaatccaaacagcactctatggctagaggccactgcgacctctcttttctaggcataaacctgagtccctggcccagggtcacagctggcaggctgggcactgacggactccaggctttaagtcacattgctacactgtactcagggtatctgccgcccgggcccagacccagagatccaccctaagggcgaggataaggagacagaggacaggcagatgacaaggtgggggcagttctcatgaagggtttccttcttggacactgatttcttcccaggatgcctgaggatgctgaccagctccttccatccctgtcctcctcacctctttccacatcccctgcagatcagcccagcagtgaggcacagcctagggtcggatgtcccatagatcatcatggaagctcagaagcaatccgttcttcattttagaggctcctctccgtcaagattctggaaacacaggagaacactgtgacctttctcagaggatgttttcctaacatgcctgggaggaagacttgaatggtggtgtgaaaatgtcttttcatgccctaatcaatagcccatcaattatgtatgtacttatgtatgtaaaccctgttaccatcctgtggagaggataggacttggtgatgtccaactattgagctctttcttcaaagtcttaaaggaagttcagtacataaaaccatggcagcgggttggctctggcagagtggagtcagtcagacatctggagcgctgtcctcactctgcctccccaccctcgggcatgcttgttggaactgacagctccactgctggcagtttataaatctttccagtgttttcattgagggttgtcaaaatgttaaggcatattaggccatcatggagcaaggtaacctccaaggcctttacctcttctaaataatgctttattctcttttcttctggtcatgaagatacagttggaaattcctacagattggctttgcttgaaaggctattgtagaccattaatgggcgaaatccctgtatttgaaattgtaagatgcaatgagggaaggcaatccacgtgatttccttgtgttcccctagtggagtgaaaacagatactgacgattgtttcctcattcctggtggcatcttgagatggtttggtaacatccaagctgtgcagatgttaccacggagcatggaggcttttctgaactcctacaggtttcattgtctgtgccactttttggtacttaccatttacgtatttgaactgtgtattgtttcacaggtgtgtgttttccaagttgccactctaccaaccctttttgtatattcctgagttcaaaaagcactttaaggaaacaaactgacaaaaacatgcagtttaagaggaggaaacaggaagatggctcacatgtagcttgagtgaacaatcacatttagcacagtgcaggctttcagtcttttcatgtcatgcgtatttttgtatcctacggacaatgagccttgactgcttttttaggcctcttaccagcttcctcctctgaagtgtagtaagtagcttcctatataatataatttgtagatgactaaaagcaaggcctgatcccacatatctcttttatagacctgctacattgccagaaaggtcttcattgctcaaccttacacccctcaaggataaaagctttctcaaccacaagaattcctgcagaatttggctatgtctcattcattattgtacggggtcagtcgctggcccaatatctaggctatagtaggtatctctaaactattgggaaacctgtagtcatttggtggcttatttttcagtgagtgcagataggagatggaatatgggtggatctagatggatagagttggatcacaaagtgaaaaccatcacttggtgggaccatgttggggaggatcctgaggatgctgaggtcagtccatgacgtctgtgacaggcacatgagggaggggccatgtcatatgtgtctcaatttgccatctctgcttagagcctgagtgactgcttgagaaggtaggcccaagcccagaggacagagcatatgagggtggatttgactgagagagttggtaacacactttctaagtgagaaatacggatgacaggaacaccctgcctctgcccgtggcccagctctgcttgagtctgtcactgtctcctttcctggaaatgtcagtgtcgcttccctcatgcgttttggagccttgagttcaggctaaaacagggccttttgaggggaggagaaaaaaggaaagagggcaaaaggatgaagtgtgatttcttaaacaggtttttaagaaaggagaaaagggccttgcttaattttgagacttccaaaaggttaggctacatgtaaagggaaaggtgaggttgatgctggttttacaagaactgctttgctcagttctacttggttcttatcaacgtcggtgacccgcagaactccttacgaagcagtctagtggctacaggatagcatccaaagtgactgcttagagtttatgaatcttcactaatgtgtgtgtcccagataacaggatggaaggaaaaaaaatgaaacctgtgtagacactgagtatgttagtttggaacagtgaggaaagctttaagagagaaatcagtattatatcagtttagccaggctcacaatcaatagtcatttgataaaagctgagcgtgtgtgacactctcctaacacagagtcctgtgattctttggggatgtctttgctggtgtatcagatagctattgctatgcaagcaccccaagacttagtgggcttaagacagcatcatgttatgaaaatcatgcattttcatctttaataagaagggtttggaataaaagaaggaatactgactattccttctgaatattggatgatctggggtgtgcctcactgtgtgtcagctcactggcttgcttgcttctgcctgggaagtggccttgccaggggcatcttttctgagcagggctgctccatgcatctctccttctctgcctcctgggactgggaggcatggtccttgcatggccatgacaagcgcatgcaagctctcctgagacttaagctcagaacaggccctggaacttccccctcatttctgtggctccaaggaagccccatggccaaagaatggggaaataggctctatcccttttgcagaagtaactgcaatgtacacagactgtaagtaaagggaaccatgaagaattgaggccgttagtgcaattaacatgcttagattactcttaagctcttattgttgctattagtgatctctctggaccctggaaatgtccagcaaggctttaggatggtagctgtagtagaagcatgagtggatagtcatgacctgcttttatcctcactgtcaatgtttttctttccatacattgttgaggttaagtttgctgaatggtaaagaagtataatttttgaaattgttttctgtcgtcagttagtaaatcaatcaacatttactgcacagctactggaggagcagcacctgctacttcctgggttcatggagccataggggtgaggagggtgacatttactgagtaatcacttcgtgtcaggaactgtgccaagaacctcgtaaactccagattaattgagatagacattttggtggggagatatctatgcattgttttattgttagatcaggcataatatatccaaagtgtaaagtctttggaaactctcgatgaaggaaagggattcagtttccaaggtgtgggctagaatgcagaaaataaaaatgtgtaagtgaaggttttctgtggctttggtaatggctgtgtttttgatatatagtaaacaatgataaatcgttgttcttttaactctgaattttttttaaaagaatgtcactgtgcacggtttgaagctgcaaagattgccttcgagagggaggagtcatttctccacgtccctataacattatgtggaatgttgtctgtcagctttggactgtagtttatatgtcagtgactgtagtttatatggagtattttgtttaacttttcatttgttcccaatgttacaattttgctttctcatagatatgcatatggaaccaatgcactaataaggttcatttctcctaatatatgctgtctgtacatttgtcgcctataatagttgttaatggttttaaagagggtcatgatagtccgttatgtcaaaagatgccattgccttctgtctttttctgtgcattcctggttttgaaaatgagggtacaatcagacctgaaaaaaaaaagcatatgactttgtttcatgacctacaaaaagtaatggtaagcaagatgcaaattcttattctccaagggtatatacactgtcaaacaattgaaagaagccaagactatctgaaaaggcctatttttcagatttcatcttggagacctttcatcatagttcctaccccaagaaaataactaatttgctctagccttatggaatagcctggaatggctgcctgggccatctgagaagttggctggtcctatccagggcttccccagttggcctggctttgctcaggggccgggggctgaactttagcaggttccactagtgctgttgggagctccacagagaaaggtcgaacgcttggtggtttgtccttgtggtcagaccccgggatttgacttttaagaatactctgaaaatgaaaatggatttcctgggaaggaagtatgtgaagtcattaacattaattaatagcttatcgaaaaattaggctttcaggctggaagaaagtaggcaggcctgaagaagggagctcaggaaggagagctggagggaccacagcagggagctggcccagaggcaggtgacgtcgcccaggaggctggacctcggggattgtggttctgtcaagaaaggatggttgctggtgggggctggggggctgtgggggctgggggtgctggagcagggaggtgtgacccaccccagggaataggaggagagaagtgggtagggttttcttggactctcacttcaccttccggttggacgagctgcaagcatgagcttctaagctttgcatcccagagtgttggcggctatggagatcctgcgggcctcactgccgccattccccatggccactcagccagcactacctaggcactgagctccgtgagggacttttttcctgctcaccttatctcaatggggtcaggcgggctgaagcttctggagtcttggtgaggctgttgctggattgaatatgagcagctgcagggctggaggaacccaaatctcagtggagcctgttcattgaagaccttactgataggttagtgccaaggggtgctgacaggtacagttatggggaactggcacatacgaggtagcagcatctgccctgaccttggccctataatcatccgtggcattgttgagaacagataaacagtaaccaacagtgggctcacatcacagatgttttcccttggtgcttggtgggccccaagatgttggggttcaaggtttttattatgtctagggagggccagaatcagtcctatctgctcgcattgagatggcctttgttcaagcaagaggtgaaattaagtgtccagaggcagaaatagatttcactctgggttctgttatccatggttctttgtagattctttctgaatgtccacaggtgtgctcaactgctaaattcagctgcctttgaaatcacaaaaagggctcaacaagtggaggtctcttccaccagcaaagcaaaggattgtgtaattcgatcactagggtaggctctgaggctgcgtggcccgagttgaaagctgagctctgcacggacagctggtgggtctctgcctaagttattttacctatctgtgctctgcttcctctcctcaccagaaaaccgaggctatggttgtatttgcatcataaggttaccaagaaaatgcaataagctaatgtacagggagcacttaaaagactatctgcacgcaggaagccctcgataactaattgtttgctgtaattattaatggtcaccccacatataggtgaggaaatcttgaattgccctggttggtgctgctgggtatttggctcaggtaagagtggtatagcagcttggctttttttagatgagaagctacctccccctgaaagggggctgagtttttgtctcctacagctgctcccctgagaagatattcagctcttcccaaactactggttgtttagaaggtggctgtgtacagagcctggtcatgctatgggtcacagagacacagggccactgcctgcacccacctggacagcacccttctgtgtgacttccatggggaggactgtgagtggtgccccagtgttgggatagggaccagatgactgcagaggaaacaccattaacatttgtctattcagcaaacactttactctcacatgaatgtcgatgtatctttgggcttcttataaaagaatcccacattcactcaacgtctgtgagtatagacattgttatttgttcctttcactttttaaagtgaattaatttgtacaatagtggttttcaaagtttgttgttcttgaaaaatcaccgatcaagcattaaaaatgcacacactggggtctcacccctgagaagctgctctgcttggtcattcaggaaaactcaggtacctacattttaaaaaaaattctcagatgagctgccaggcaaaatcacctctaattgcttctcttgttttagttctcccaacaacctgtaagagaaaattggacagatattcctgtccccattttagatgaggccgcaagtacttagagtgaaaatttgtttgaggtcacataattagttaacatattattccagataatcacagatttcttttttagacaacgctccctacatctcaatagcttaaccaaagaatgtgtcagagggccatctttttgcatctctgggttctgcagggcctgctgcaggaattggtgtccacagggggttctggagccaattctccacagatagtgaggtagttctcctgtggtcacacacctcgggatccttcacagccaggtgtgtgggcagacgagagagtgtggtcatgctacagatagcctggcattgacgttcatcactttagcccgtattccgttggcctgaactgaggcataccatgccgtgaggctcagcgagatgcaacggagtgtgggcagtgtcctcccggatgttcagaagaaaaggaccctgctgaacacatgcagtagtttccaccactattaatgaccgtaaggcaatgaatctaaatagtgaaaatctttgcatgaaacctatgcttttactgacattgtattgttgcaacaatccagggatgtagttatgtatctccctattgtttaaggatgataaaacagattcagagaatttaagtgacttgcaaaagtccacacccctgagaaacaagagagccagagaacccgtgggcagctctcagctctggcgccagggctgtgtggttgggacatacccattgaccttggaggcagaacaaagctggtatcaaaactcagatttcttgactgccatttcagtgtactttttccactacaagatatttcttactgttttgagcatgctgtattaccacagggactagcgacataggtttaagcaagtcttcagtgactgaaggagaaaaacatgtagtaaatattgcttaaatcttttctcattaccacatagaaacacatttctatgtagaagtagaagacatttctacttacctatcctgagaaccttctctctgaaaagctcacagcagagtccatctctcccgcttggcagctgcaataagtacagtaattaggaatattatttcttttctttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgccactacgcccggctaattttttttttgtatttttagtagagacggggtttcaccgtgttagccaggatggtctcgatctcctgacctcgtgatccgcccgcctcggcctcccaaagtgctgggattacaggcgtgagccaccgcgcccggccaggaatattatttctaactcacaagagttcttctgcatgttagccaccccccagagaaaatagtctccattgttgttctctcttcagcatatcccaggtatgtttccaagcaagttttgctccactataagttgatgaggacctttttttttggaagctgatggcctggcaagagttagtcttaataggttgtgtttcttctcactttagctggctctccctaatgataatgtctgttcaagttgagcccagtttcagccagtttctctgggagtcaaaagcctgtagcacacccagagagccaccacctgtccacagcatatggtctgaaggcatctctgctgctctagcctgaccagccagcccaggatttccaactgtgagctcaccctccttgtaaggcaaacagggtttagccagcgctcaccttgacctggtgacctttgaagattgaggttgcaggagaatgcaattgagaatgcagcgggtttccagaccccatgtgagccatccctgatgcttcaccctggctccatgggaaggaacccagagccctgcctggctggtctcctgctaatgagatggaaagcaggggtcctggccacaccatgaaactcatgatgttctccactcttgtgtccctgccatggctcacattcagtaattagataccagctcattaattcctgctattctttcagaagggaaaggatggtgccctttgttctgctctgctgggccctgagccctcacagcatgaagtagctagattctgcctcactccagaggcggctgccactttctcaccccacagtcagcccctcaaccatgaaaagatgtaaggatgtagctaaattacataacccaagcatgaaagcacctgacgtgtatgaaaccatgttctcagacacttgtaggcagtgacaactttataattaggcatttcatccaacttatgtatcttacatagggaaattgacatcttagcaaaatttatttgcctaaagtcgcataggtaattaaaagtagatacagctgagactagttgctataatgcccagctaggagggagtcggtggaagaggtgtcatctattttcctttgaaggtttgtaagtatttgacttttcctgccctgagactgacttgcctctgaggaggcccatccgacttagcttgaacaacccggattcttgtctttagtcaaaagcctctaaataaagaatacaaatcagcttaacttctccaaggtctggcaaagctttatacacctttcagaaacagaacacagcaaatctgcctcagcaaacatgtgcatacgactttcatctgagctatcaggaaggcatcttatagacacatacaacggaagcccagagggctctggcatgttgcaaaatcaaacagtccagaaaactttccaccccagaccactattcagttgtcatctgaaataatggaagtcagagtcaaactcatcaattaaacgagaattatttatttatcataatctctactgcctgctgcttcaaatgctttctcatgaattaatgagctcatctacgtgcatgtcaatattttgttttaaactacaaaataaaacacaggattaggttttgttctcagtgtctacctttctgtggcattgatgcagatagcaactaaggattaaatcacagaatggttccctttttaatttatttatagaaatgggcttttgcttttattagtgatgaatgaagagagcttgacttggggaaatttagactgagattattgaagtggcctagagtttggaaatttttataaaacccaactgtgcaagtggattgaaattgtgcttaagaacaggctttcatgccagacttgtgccgaattccatttggttcctggcagaaaacccttgaagaatggtatttggttttgtttatttggcatttcaaatactggttcatctggcccccatcctgatcaaaaatagtcagaagtagaaatgggtacttgagtggcagcagagtggattcatctgggcatggcagcacctagcgtaggtctccaatatgccattgagaatgttgttgagtgcaggataacctttaacataatacccctatccctctcctgtttccttgctggttgatcatctgccctgggccacaaatagctctccctctccactctcccaaggaagaaagtcctgacaaattactcccttaacccagctctgttcctgaaggcttgcatattccatcacagaacttcctcttgggatggagagtaatgttgggacagatgactgtcctactttctagcaatgaaaaatgattgcatgaagcctcacattcctgatgctaatgagaatctgtcctttcagctggcgtttgcatcaggagatgccactgcttgatttgtaatgttttgcactaacactctgagtgaaccctgtctttgggccgttccattgcacaataggcagttgaaatctatgcttttctcaatagggagtacaaaaaattcatcattttaaagtgggctgtcagatctaagaaataaatctcagttcataaacttgaaaaactcagaagtgttaaaaattttattcactaagaacataacatccaagacgagagatcaattttgcatattattatttctacctgaagtattccatctcacttaaaagaaatatttgtttggaagcattggttggtgctggtagccaaggctgtccaacaaaaaaagcgagtttttaaagaaaatgttattccctaagggtgaatcttaaaaaattgccaaatgtattcttgagatgaataacaggaagcttagttctagaaagggcctgagtgattatcgaatccattcttcatttcacagacgagaaaatgagtttcagagatgcaaacattcctactatcacagaactagtaagctggagaacagacattaagacctgtaatagtgattcccgtgtgaatgtttttatgatgaaactgtacaaaatgatagaacaataacaatgtcaaaacacctatcactaagcactttcatatgtaatatctttttttaattataacaaaatggcaaagtaggtgttatctccatttcacaaatggtacaactgaggctcagaaacattaagcaactgtcctggggtcacaaagaagacactattagagccaggtttagtccacatattcaatttctttgtttatttccttcactttgcatgagaattcctttttgctgtctttcatttttaagcagaaacctttctttaaagacactaatgatcaaagatctaaattaaaaactaaaactattaaatttctagaggaaatcatagccctacatctaatatataatagaaccagatggaaattctagaaaattctgaaaagtacaatatctgaaaaggaagacaatacttagcttggattaggcaatttgtttcttagatgtgacaccaaatgcacaaagaacaaagggaaaacaagataaattgggcatttttgaaattaaaaacttttgtgcatcaaacaccattaaggaaatgaaaagacaattcatagaatgggagaacacttttgcaaattgaatatctgacaagagacttgtatctggaatctattaagaatgctatataattcaataacaaactgacaagtaaccctattgaaaatgggagtaccaagtataccttttcatttaaatcattgaacagttcacaatggctgttgtaaagtttttgccttgttactgaaaccatcatctcttggtctatttctatggagttattttttcctagttattggcagtttgcttatcttttatgtgtctaataacttttaattgaatgtagaacattatggatcttatatttttgagaatctgaatgtttaaaattcctttgaagagtttgtgttttcttctggaggcagtttacttactggctgtgagctcagtcctgttgaggctgtttcacgacaggctgtggctttgtcagggtgggtgtggatcagacatctggtcatcaaccctgcatattccagcctctttcacaggctcactcgctgatttctgtttctcccacattaaggccactgctctctgatagtctctgcctctcccaggctggaaaacagccttaagcagagagcccttgcaagtgaggagccccctcatgcttcccccttcacctccagggtcatagtcctgtagcgtatgtaatccccttcctaaaaacacttgctttatatatttccctagttgtgtaattgtttatagtgagagaggaagcctggttactcatgactctattatgagaagaaccacaaatctctcctacttcattttaatcattcgatgttagatgtatttaaccactttgttgccatgtttaaatttttatggggagaagcccaaggtaaataataaaattaacaaaacttttagtccagtgtgtattcctcagagaaacctcaggtttcttttcttttttttttttttttaacaaattcaggtctttgttctagaagttaaaaaaaaacaacatacaaccaaatatagttaaaacaggaaaatctatttgtgtttacttcatatctttctgttgggtcagatgataatgtttagaaaaatactgtaacattcttactttatgtggacaaacctttagaggctggcctctctgtagaaggattgcacagggaaataattttgagcctactttcttgtctttatcttctatgttctcttctcagcttcctgtcttgattggcatggaacttgctctgctcctcatgtttctatttgtttaggaaattcactaggagtgtacaagggacagattgtcagctgtcatccaagtccctttcaaataaccccactatcctttgccttaggaagtctgagcctccatcagatcccggtcacattgtgagggaggagtgaccagccaccgagggccacctcctgctcttctttcctctctcccctttgcccttgaggtgccctcaactcccaggctctctaatcatgctcttcccagcccaggattgccctggccagtgcagctcttccttaggttctagaaccactacctaatacctaattccaatagggtccttttgactgaagctgacttaatgtgtttgagaaagcagggctaaaataaaaagaccctaatgtagcagaggccttgataaattctaccgaagtgatgagaactgtgggaatttctgactgagcccaaaagttattagaggcaagaatacttctctctccagtaaatgcctccccacctccacccccatttatagaaactttcaaatttatactagcataaggccaaccttatctgtgaccatgaataagctatttcactacctcgttgttctggtcaaaataatgcatggggctgggctcatgcctgtaatcccagcactttgggaggctgaggcaggtggatcacttgaggtcaggagttcgagaccaacctgcccaacatggtgaaaccccagctctactaaaaatacaaaaattaaccatgtgtggtggcacacgcgtgtagtcccagctacttgggaggctgaggcacgagaatcgcttattgcttgaacctgggagacggaggttgtagtgagccgagattttgccactgcactcgagcctgggtgacagagtgagactctgtgtcaaaaaaaaagaagaaagaaaaaagaaaaaaaaatcatgggctagctactctgcttgtattttttgtttctgtccatcctcttacttgatacccctccacgttctaaaaacaaagcctcccttcacattttgagtgtgtctgctatggataatgaggcagcaatcctggttctaaagaattgtgataaagcagtcactaaggatcccattaaaggtcaaaccatctaattcttaatctcacggcacctgcttgataatgatggatacttattaaactcattccttctgggtctcagaataccctttagaatgatccaatttttcattcaggcacttgaagttcattaaatgaatgctggagaaactgttttctcattgacgtacttgctttaatgaaatgagaaagtaagaagtgcctgaatattggtggtggttctcaaacccaaggaaatctaggggtttgtggagatccagaatctcctctctcctcaccacttttatggcctttatctaattttacttttcagccacgtttgatgtagctgacttccatctcgaaacactctcttctgattttccctttgattgcactatccactcctttttccatgtcctcgaccggttctgtcttcccgcgtgacctctcagcattgaagtcttatctgcctgccctcttctggatgcattgtattcctggatgagcttctcaatgccctagtctcatatactggccatatgatgaggattcctggttttacatgtcaagccttgtctccgtaagtgaactgcaaactcagttttcaaagtgcccatctgaccactccactctgatgtctaacatgtgctcgcttacatgtggccagaagagagctcctcatccccatggccatcgctcctccaccagtgttccatctcagtaaatggcaccaccaccaacccaggtgctcaagccacaagccctggagttgtcgttcgttcactttccatttcacctcatctaaccattcagcaagcctcatcgatcccatctccaaaatatacccctaatccatgcagtacacccacctccccactggggctgcaccagtccagccccagccactgttgtctctcactggaatctctgaagtcactcccaagaggtccctgcttccactccccctcccacacccattctccctaagacagccacagggatcctgttgaaacaagtcagatccatcaccccctggagtacctggcctcctttgcacatctcagaccgaagctccttactgacctctaatggtgtgcacgccctgttcctcggcccttataagaccccttttccctgcacactccatgctctggccatatcggcccacgttctattcctcgaatatatcacattccttctgcatcagtgcctttgctcctctgccccgaaggctctctcatagatcttcccgccattcaagtcagccccatgatacctccgcagtgacgcattccttgaccactctacctaaaatctctctccccccgccacacaatctctttgtcttgttttatcttcttctcaacacgtatcactatcaagacattgaacaaggaaatactgacggattttcatttcagtttcccccttagagaaggacattgtctattgttttttgctatatctgcaatgtgcttggtagttaggaagcattatataacaattttaaaaatggaaacattcagtttttaaagtaggtttattttttttttttttcagagaagccaagtaactggtatgcgtagtaataaaacatctcaataaagaattacaagacttgaggatctgggcatggtggctcacacatgtaatcccagcactttgtgaggctgaggtgggaggattgcttgagcccaggaattcgagaccagcttgggaaacatagcaagaccccaagtctacaaaggtttttggaaaaaaattagctgggtgtgcagatatatcttcaacatactgatttgctctattttggatatatacccagctgagagattgatcatttggtagttttagattttgggggaactttcatactgttttccacactggctgtactaatttaattcccaccaacagtgcacaagtgtttccctttctacacatcctctccaataaaagccacttcattttgagccattagtgaactgagagaaaacagcactatggagggagaaagtggattgtttccaagaagtaggtgggcaaggagcaatgaaggaaagataataccaaggcaaatacctggaggatgttaagccaagagcatcagaggagaaaaggaatcatcaagaggttggttagtgggtacaaacgtgcagttagaaggaataagtaatagtgttccacagcacagtagggtgactatagttaacaatatatgttttttttgagacagggtctcactctgtcacctaggtgggagtgaagtggtgcaatcatgtctcactgcagcctcaacctcctaaacacaagtgttcctcttgcctcagcctcccgagtaactgggaccacagcatgtgcccaccaagcccagctaattttttgagtttttgtagagatggggtttcactgtgttgccctggctgagcttgaactcctgggttctaagtgattgtccctcctcgacctcccaaagtgctgggattacagatgggattacagactgagccaccgtgcccagtcaacaataatttattgtatatttcaaaatatctagaggaggctgggcatggtggctcacacttataatcccagcactttgggaggctgaggattgtttgaggtcaggagtttgagaccagcctggacaacatagtacgggcctgtctctacaaaaaaagaaaattcaaaaacttagttgggcatggtggtatgtgcctgtagtcccagctactcaggaggctgaggcatgaagattgcttgagcccggaattttaaggttgcagtgagctatgatggcaccactgcactccagcctgggtgacagagtgagcccttgtcctaaaaaaaataaaaaaaaaataaaaaaataaaaaaaaaaaaaagaaaaatataaagaaagaattagaatacttgaaacctagccaaaaccttatccttacttagggtgatcctgtgcttccatttgctaatccatagatactcctaatatcttccttctcttcttcataagtgaggagataagatgaaataaggaattcgtaaatacaaagagagtcataaagcatcacataaatgttatgtttattttatattgaaatgtccacctgaaaaactttctctggcagagtgcagggccagatgaaattcacatgaaggaggaacacctgatctgtatggccctgtcattattatgcatacccatggaaccagctgggcactcagggttatatgtggtagccacagcagggtgatttgcaacccccactcctatatccatcaagacaaggccaccacgaggccccctatcctgctgtagatgacctgaaatacgctgtccccttagaggttgctttctttggaattgatcatgaacatctgtttggtttattgcagaacccacagaggccaacacagtgcctggcacattctaattgctcaatgatcttgagatcaataagggggtgaaaaatggctgctggtgtaaaaagcaggagaaaggcactgaaaggggatgagagtggacaccggagaccattttttgcccatttgttagtatttcatccactctgcaactagtctcccagtcattcctttatttttcccctgtatgagttgaagacgactctttgtggagtctaggaacaggcaagtgtccctatatatggaaaggaaggaacagttcacaagctttctaagctcacaacccagcttgtctgggcttttcaatagagtggttgccatgacattacataggagagcctttcaggcagttcccattgctaagggcaaagggtgactgtgatattaaaagaagcatttgttgctctttatactcagaggaaatcaaggtgaacttgaactcattaaaagcaaggctgagcacatttgcatgagcagaatgtaaatacaggaggcttcttgcagatgagcttctctcttgcagaagaagagacccagggcctcctgagcctgtttgttcttaattaagagagatccttttgggatgagagtgagtttgtaatggcatttctaccacaatgtacaacttctcaaatatctccttcccccatatcttcaaagttttaagtacagcccttagtgcaagtttgtaggggaaatatggaaaaatgcaaaacaaatacaataaacagagaaaacaatttaaaatgattctacacacaaatgaataatttaaacctccatcatgtttgctatctgtgatgcatctatttaatattaataacttgtgaagaaaaatgactgtcaccatttttaacaagcctagtctattctggctacaaaccttagatgactgactattcctaacagggccctgcttattaagagtctgttatcttctttaaatttaatttcatgaataatgaaatgtttataagaggaaaacaaatatcctgtctaaagccagcctctccttactcccttccacctctgtcaaatatttatctgcctctaccttcttcctttttcttttcttttctcttttctctcttctctttctatttcttctttctttctcccttccttcccttttttctttatctatctatttcttcctctctctcttccttccctccttccctcccttcctccctccctatctctctatccctctccctttctttcttttcttagttttcaacaccaggctccatatttaatgcacacagtgtaactagcttcaatagctgatcattctttctccagagatgtcttattacgaagcaaggagcacatacaaagcagttgtattgcttttcaaattccctcttcagtgaacatagtcattaaagaattgtatcaagaagaaacacttttataatgtggctgtccccaaattctaaagatggtgttattattgatttagtaatagcttacaaatcatgacccaaaattagttcttctgcacttatgccccaacctttgtaaaatctttattgaacaaccatggccagtaaccataacagataatgttctattaagtgcagtttttccatgggtcatataaagtctttttcttggagctcatataagagtccatggaaccttcattcactttggtgtctgcagggaactcttttcctgtggagtctgagtgatcacgtggaatctcaccccatgctgcccacagaactgtccatctaggtgtctcttgctgaccagactctgggtgtacagcagagctgacagcccaggtttcaaataaaactttccagaatttcacacacacacaaacacacacacacacacactcatacagcagctctgctgtctaagatgtcaagatgtcgttttgggttttatttgtttacattctgaattctgtgtccatgtgttttaaattttcctctagataaaagcgtgatagagcatctctgtggggaattgctgtgaagaagtcccactgtgggatgtggtgcagggtgaagatgcagatgagagaaggaaggagaaagctcagggagagggaagtagaaagaaggggaagaataaacggttggagaagctgcctgatgactttgagcttttgtagatcagcggatccaaacctcttgttgtgcaggaagtgttagagaacattaaaagattagcctagagtctcaggtagttcaagagtcagagttgggaccaggtcttctggttctgatccagagctttttctcctacttagctgtcattcccatgccattcatgtcatgttttaagcagttcagcaagcattcttgccgtgctgacttgtctctagcatgatgttcaagctctgaaaattgcaagtgaatttaaatagcctctgacctcagtgagctcaaattctcactgtggagatgacctccagccccaaaacagatcagagacctgctatgtaacacatggggcaagtgcaagagtgaaaggaggaggatttggggatctagaaaggtctggggcaaagcggcaagagaaacatgaggcatttaggggtgaacttggtggaagggggaaggcagagctgggaaaagggcaagactccttggtgaccaaatgggtagacatgtgacaaatcactgcccccattgtggaggatacaatgtggaaagagctgtgagcctctccccaggaagctgtggtccacatggatgatgatggggagatgtgggaaacgccaggcagagaggaagagagctgccggggaatagcatcattccaccaacggaggaccacagggcttggtgtaacacccacatgcagagggtaagacgaggacccatcccatcatcagcggtgccaacgcttacattgcagcaccttaccactcagagtgaggcttcagcactctgcgaacgtttgctgctgttattcattgatcacccatgcacctcacaacagccgtgcgagactgattgggctgtcaccactttctccatttagtggacgaggacaggaagtcacaaaatgggcctgagatcttagagtttgccaagtcctgcagccatatgtaagtttccctgatgccggtactcaggggtgctgtgctacttcagtgtctgctcctcccagagtgctgtagcccaggagaagaggcctttgtgccatgctttttacagcagcacctccagaagtcacgtaagagacctggcacttccagaatcctttccagcctacaaccattttcacataaaaatgggaaaaatggaggcagaggaaaccatatatcccaaacgagggccagttatcccctgtgtatgtggggctgaaggctcatgatgcagtgaaggaccaccatttccctccttccagtgtattaagaagacatctgggtgttccagttccatcagctcactcatccttcagtagagacaagtgagcttggcacgtggatatgtgaagtgctgtgtgcattcagcctcagtctcctatggtgtcccagctcctggactctaagcctccctgtttcatttatcaaagagattggatgacacccacctatgttggtgagaatggatcttcttcatctacccattcaaatgctcatcttttctagaaacaccctcatggacacaatccagaaataatgtcctaccagctatctgggcatcccattggccggtcaagttgatatccagaattcgctatctcagctgttaaggccaactcagatctaaggggaggagaattcaactccccctctcaatgggaggaatcctagaactgctagagtttcctgccaaccaacattcttaccaagtaaaataaaacaagaataaactttacattcggctacagaaggtgatggaagaggtagagcaagaggatctacaaagatgctaatttcatttataattattttgtgatggaaaaagtaataaattattatgagttgtcaccagactctttcttaaccagagaattctctttctttggaaaaatattttgaaaagctgcttgaccatggcaagtgagacattgaggacccaagcaacagatagatggtttatggcatgctgagtggagagtaggggacacttgcatttgcctttgggagggaaggagagaggaagaaatagaaaaaaaaggggaagaaactggagaatgtgaaagatgtgaagcatcatgggaaagtagaggccgggaaaaacatcctagtgataaaggtagaagaaaagagttttaggcaatgcctaatatgtgattgaaagatgcatgtcccccttcctgccatggatgctcccccctgaaattttaaggcaaattttatagactaacggttgccctgtgcaagtgttgtcttgtgtgtatgtgtggagtgtgaagttggggttgcagctgaattgcacctccagttcatcatgacttcgtatctcattgcatagtctggaaaaaggacaggcatagacaaaggaactcaccagcagaggtggccagaagaagaaatctttcctggcaattgaaagaaatcttagtgcagattgtggtcttgcactaggatgagacagaggttggagcttgtcttcctcagacatcaaagagcggggagaacccaactgccaactggtttgcatgtggcttgtggtttgacagctgactctttcttaacttctaatccaagggtcagtacaaagccaattccccttctcctccaggaggaagaaccttctacagcctgaggtacccagtacttgtcctgagtgtaagctaggatgacctctggatccatcatgctatatttagtctctgtttcacctaacactcaggattccatgaatgtacctttagtgagtccaggacaccttgtgaagattgcacgaaccctgcctgggaagtgacaaaggtgcagacttacccttggcatcttttgtacctttaaccacagagttcacatggagttgtgaccccagctcatgtaacctaatgcaaggtgaataatacctcctacagcaggctctggaaatgtttcttgtctgcacacacacacacacacacacacacacacacacacacacacacttcttaagtctgcattccccaaataataataaggggcatgttgctctataacaatcagcatcacgaaagcctacaggactttgccattcggtttaatggaattggtatatttgaaatactgcctttggaatttttttttgacagagtttcactcttgttgcccaggctggagtccaatggtacgatctcagctcattgcaacctccgcctcctgggttcaagtgattctcctgcctcagcctcccaagtagctggaattacaggtgcctaccaccatgctcggctaattttttgtattttaatacagacagggtttcaccatgttggccaggctggtctcgaactcctgatctcaggtgattcgctcgccttggcctcccaaagtgctgggattacaggtgtgaaccactgcctctggtctgcctttagatattttacataacagattgtattacaaagacctacacgcctccaaaaatactttggaatgttttaattatgcaaaaattgagaaaatagttaggaaagatgcatctgtctctgttaagaataaattcaattattagaatttaggggtgcccaacagcttacctgcagcaagattaggttgagttctactaccttcaaatgcttacctatgacctttgaagttctgattattctgggagcttctggtgctacatccactcaatctgccaggagaggaatttatcctacaggctgcataatttccttctcagctgtaaaatatctctttataagaggtgtgggcgagaaggaattatgggagcaaatacagtatttatcacttgaattaaacgactaaacctggcaaatagttcagctatcgatccacaaatagtatcaatccacaaattagcagcctgattcagataatctgatcagtagatatagttatatgtgagcatcataagcatcaaagccacttttatgtgtattatttttcttgtcacccacaaatcatgttgcaaagattgatagtaattgaataaattgccatgtgtacttaaagactgggcttgttggagacacaacacatttattagatgatcagttttttttttcctgttatgtcaatgctcactggaacacttcttttcaaatgtaggaaaaccaagctaactagatctagaaaaacaagcagaggtttcaagggatgcctttgaaaggtggtgtggtatcagggagcacgttgaattggaagtcagatgtccatgtgtggattcctttcatggcactccctgattgagacaatctgtaaaatccctttaacgtgcgtatgttatgattgcataatgtaattcttgtttagggtttattgtgtgactctttgctaagtaactgtactgtcataaatggagtccgagcagcggggcttgtctccccgtgagtgtgagatctgcatgctgccacctttctcctcctacttttctcgccaggtaccacagtctgtgtaagatgcaccaggctgatattttgtaaaatcaaggtcttcaccttccatttatgtggcacgagctggaatttgccagggtcaaatagtcaaccaggagttctttatggattcagccacatgggagaacttgagggaccttgcatgtcttatattctccaaaactccatccccacaggcttgccagtgtccaaaaggcctgatttttgggggaggaggcagctctaaaatagtgtcaattctagaactccttttttaaatgtcccaggaggagtaactattggcatcatcagtatttaaaactttgggctaattacatcacctgattatttccctcctttgtgctttctagagggatataaaccaatgagagtcttgagaggtggagtcagttcagctcagaagacactatcttgagggaaaaggccatgatgagtgggtttgtatgttgaattggaaagaggagaagggagatgaagagaaatagggtagggggagtactgagaggaaggatctgaagggtgatagagagaatgctgcctttggttaaaatttcaccagtgtagactgtgtttatgtagcttagtcagaatctcccttcatcctgtagtgctatgtttttgtttatttatgcaatactcttcctgtcaactatcacaattaagaatccctagtgtagcacagttatgaatgtggctgacctttcttaaaataatgtcctcgagctctgtagcactttaaacatttcaactcttttgcatatttggtttttcataatgtaggttgtaacacgatagaaggttagggaattaattgagtgggccatgatcagcttaagaaaataaaatgcaatagaaatatacctagtgcataataactagtagaatgaactaatatgaaactttgtccattatctatgtatgtagtatgtgtttactgtattgctatataaaatatatttctcatagtagattgcagtcacaaaagtttgaaagcctttgaaccccctttgaccatggaaaggaagagggattctgtacaggaaatggttaactcagcaggcctgggttgctcaaaccgtgcacattctcagaaagacctgctttgggactggcccttggatggtcctgggaaattagccaccaacctttggaatagtgtgcccaataagaatttttttggatgccttaggcttcagcccacatgaaaccagtttgatgactttatcctaacaatgtaatttatgtatggtgaatgcctgcttttgctttggggtggtgtgaggatctgaggtcaggtacgcaggtgccacatgcctgcatgactaacccccagtaagaaccctggacgccaagccatgggtgagcgtccgtggttggtaacatggtttctgggaaaattaatagagcccgtgagactccactagcaaagaacacctggaagctttcacctggtttctcctggactctgccccatgtaccttttattttattctgatttgaactcatatccttttgctgtaatatatcagaacagtacatctaattcagaaaagtaagcttttctgagtcctgtgaatcctagtgaatcatcaagctttagagtagtctcagggaacctggcgcagatgcagagattagacttgagacctagagaagttaagggctttctagaacatgtagctcaagcctgggcctggagtgtgatgaggtcatggacattaagctggaatgaaggtctgtaccaactcagtccttttctggtgaggcagcatggaaagacattggccttttctccatctgtgatgacagtgatccctggacgtgacttcttcaagtgtccttagtgagtttaactgggtaagagcaaaagaaatgaaatattttattcctttctcagtcccccatcaaggacatcaatagcataaaactgctataaaataacaaagcttattataaactttgcctccaaaagtggttctagcctttctgtaatctttcatatgagcttgttgttctgttgatcaatgaattcggtaatattctatttttaaaattattttaattatgatataaacaaatgagatacctcttcagagtccacatgaatggaaatgaatataaaatcagaatccaacacataaaaagaaagttcagcaaatgcaggactccagtctccactgcttcacagtagggtttgtccttgtgttttcttgttttgtttgggaaaataatgcaaaagagatttgttgtaaaagctttgaaatttaattatgatcagggagttctaaaggaaattaaacatagcatgagtacttttaaaaaatatgaatttaatatagcatcttatcaaataattcatcccacacggctagctcacttcccaccaggaaatagaaaagaatttttgaggactcttaactaataataatttctgaatttctctgacaccttcactgtttctaaacattttttttggtcatgttaacttacttgattcttcagagtttgcttattatagccatcactttctaatagtacatagtttgaaaagcacttggccgtcttctgcattctgggaacatgtggcttcctgacccacagaggatggcttctcgctgtgtcctcatgtggtggaaggggtgaggggtctctctgaagtgtctctgctaagggcgctagtcccattcttgtgggctttattctcaccacctaatcactcccaaagtccacctcctaacaccatcgcttcaggggaaaaatttcaaagtatgaatttggggagggggcggcattaaatagtcgatgccactccccatgctttcttttcctctgttgtggttttcagatgaacagagacttctggagttgatttgctgtcttatttgttctccctgcttgttctcgctcatctgggcaggtggtttgtcccttcttccccttatccaaatgataaattcctctccctcctctcctttcctcttccagtatcttccttcagctcctcctcttaggagctcaggaaatctgtctgcacctatcatactgacagcatgagcccaaatgtttttccgtagttcatcctggatcccggaaacatgggtggctgcctgcctgccagcctcagtttatttcccagccttactggtttgtaagctttaattttagaaaagaggacagagccatgcagtccacagaccactgcatggtgcttcgtcaccaccggccggtgctcccatgggctgcccaggtgcccaggcgtcctgggtccccaccctcgcatggctgtggagccgggacagctatgacatttgtgtggggttcttaaaaatgtgagaagctcctaatatgttgttgttaaactcatcctctctgatagaatttaattttaaacacaattcccccgaatacaccctaatgtgcttgtttcatttctggagactgtatgcatcactttccttgtctggccaaggccacaacagcgtttgcgttagccactgtgtccctgagtagatggggccctgtttactcttggcctgctccgtgggatcccagcccggccctactggacctcccagctcttttacaagtaacgccttctttcccaggtagccccattttctcctccttcatgacacgcctgtgggtccctgctttcctgggactgtcatcgatgtgcacgctggtgcctatgcacatgctccccctgcatcctcctcggtggggctgacacgcagggacttgcccacatcttctcatcttgatagaaaggatccctgtggcaagccctcttcctttcttcacaaagctgcgttcctcctttcccctctcctttggatatctgccctgaagaagctgatagaagcagatactgcttctggtaggccccgctctgcctgctccgatctttcacttctgcccactccatgctatggccttctctgtctcttcccttgttaactccctcgtctgcatccaattcctgatgcctctgacccctgacactgtgtgctgcccgcagccagaggaaaccacgttctggagtttggcagacctgaaatgcccacaactctggccttacttatgggaggcccttttcttcctcttccaagctctgagcagctccgaccacaccatcctcacactgccacctcccctctgtcctcgaggcccacagtcctgcaggtgcctctgagagtccggcacggtggggagtccacagggctactgtcacacccatactaacctagggagcctgtctctgaaacactgccacatacttgttttctcccatgttccatgtttccgatttaaatgagagacatgaccatttctatctggctctatgtccatgtcttccttgagacagtgcagtggtggattagaaattgtcttatgtcagctgggcacagtggctcacacctgtaatcccagcactttgggaggctgaggcgggtggatcacgaggtcaggagatcgagaccatcctggctaacatggtgaaaccccgtctctactaaaaatacaaaaaaaatagctgggcgcggtggcgggcgcctgtagtcccagctacttgggaggctgaagcaggagcatggcgtgaacctgggaggcagagcttgcagtgagctgagatcgcaccactgtactccagcctgggtgactgagcgagactccatctcaaacaaaaaaagaaagaaattgccttatgtcaaaaattagcaattttatgctgggcatggtggctcacgcctgtaatcccagcactttgggaggctgaggtaggtggatcatgaggtcaggagatcgagaccatcctggctaacatggtgaaaccctgtctttactaaaaatgcaaaaaattagttgggcatggtggcgggcgcctgtagtcccagctactcgggaggctgaggcaggagaatggcgtgaacccgggaggcagagcttgcagtgagctgagatcacgccactacactccaacctgggtgacagagcgaaactccatctcaaaaaaaaaaagtaaagaaaaaagaaaaaaagaaaaaaattgccttatgtcaaaaattagcaattttaggccaggcacggtggctcacgcctgtaatcccagcactttgggaagctgaggggggcagatcacttgaggccaggtgtttgaaaccagcctgggcaacatggcaaaaccccatctctactaaaaatacaagaattagccaggcgtggcggcgcacacctgtagttccaagtactcaggagattgcagtgggaggatcactccagctcaagaggttaaggctgaagtgagccatgttagcaccaccgcattccagcctgagtgacagagcaagaccctgtctaaaagaaattaaataagtagcaattttggcccctggctatttctctgcccctgacctatgtttttctgaaatgttatagacatcttccaaactgatttcacctaaatatcagaaatcgctcatcatggttcctttgtccagtgctgtggaaggccccagaggaggcttctgtggggtggtgagggcaccaggtgtgagttgggacctgagacctggtccttgttcttacagccgtgatgctgatgattaggaggccctcccagagcctccagacaggcttacaccatctggagcatgggcctgggtgaggcctcgtgagctcctgcatcataacggtgcttcctgctgctccaaagctgtggaatgtgtggtctgggaacagccctggctgaggtgagcgcatctttgcttgccttccacgtgacagacctggacctcagttcttgggaaggcgtccacgttcctttcccagcttccccattggatctgacgctctcctcttgtgatacctttacctgaattgctgggagattcagcgtctggacttccccactcccagccataggaaaaccttccccccagaagtccctggtgaccactcacacagcctgatctgctgccaacatctaccccttctggaagcagctgtcactgtttccagcgtgccagcctgacatatttcagagtgtctgcatgtctctgagctattaatacacaaaataacgtaagccccctcttctggactccccagtgtgtctgagaatgcctagtaagcatccatctggttacttttagctctaaacgttggttactagctcagcccaccaagagctcacatgcccaagctctccctggttgtcttatcctccctggctattacctctccctggctattatctcttactgaccattatcccccagggcgaatacaatcccttcttcttcacactgaaagccaccactaacacaatgatgatgtgtgtttaatgagtttcacccgctgaagttttagataaactatttttttaattctaatcttgcaaacaaggcttctgtgttcctctggtttctgggtcttcctcatgccaagaggccctccctaacaccttagccccagacctcttctgtcatctcagactctaaagcaaggtttcttaacgtggggtcccaggggcctgtgaacttaaagaaacaaaaaggtcataattatttttattaaagtctcactaaaaaactgctgcccttcagcatgtctgtaggcaaaatacacagtagttttggcattacctgtgactaaaaaaaatcacagatattcccatatcacagtggcaattgcagatatcttgaaatacaacatactctcaccattatttcaaagtcatagtaggttttaggcatacccctatttgataagctttgagactctaggcagacactcaagcaacagagctggtcagtctctggagattcccttctcaagagtcattcaggggcacgacctaaaggaacgagctttagagtgcagtttaactcaacagcctttggagaatctagcatttctggagtccaggctgtcttttccttacaaagtaaattatcaaatttgcattgtttatcattgggtatccttgctaaacaggagtctcattcttttttccttttttttgttttttttttttttttgggggacggggtctcgctctgtcacccaggctggagcgcagtggcacaatctcggctcactgcaagctctgcctcctggcttcatgccattctcctgcctcagcctcccgagtagctgggactacaggtgcccgccatcacacccgcctattttttttttttttttgtatttttagtagagacggggtttcaccgtgttagccaggatggatggtctcgatctcctgaccttgtgatcctcccgcctcagcctcccaaagtgctgggattacaggcatgagcaggagtcccattcttataagcatcagaattaaaaactcaaaattggatatctgatttgacaggcaagtcaagggagtgagctaggcagataactgggacaaggacgttgcaggtggaggtcagctggcataaacaacctgaagcaccgagtgttgctgagaaagagcaaggaagcctgtgtggctggggcctgaatgaaggaatgggaaggaaattagcttagagaggtagcaaagcgtatttatccttgtataccgttgggagcactgattttattttatttaaagcatgccttcttgtccaagacaattccccagtaaaatgttactagtttatctaagcccagacagccatttccctgatgtatctttaaaaataaaaaatctaactcctgtgttttaaatacattgtgaatcattaataaagcaatataaatacattttatttttgtatatttataactatgtttcaaaataatgcattttctttgcaatctgacatattttatcttatatatttaaacagaagattctgacaaatgaaatgctggcatcaccagattgttctaggagttcattttttttctgtctcatttttgtctaaagagacaaaaaagatctagaaccttttctaaattttagggcctgaatcccctctctctttaaaatgtgtccgcaccccccaccgaccccatcccccatccccccctacccccttgttgtgtggggcaattcagccttttcaggtggctttatatacctgtgactgcctttaaaggtggctttatatacctgtggctgcctttgaaggtggctttatatacctgtggctgcctttgaaggtggctttatacacctgtagctctggggccttccaagctaagcaacagtactgctaaacagttaagtctacatagttcctgggtggtaagtgatttccctgtattatttcacaaaatcataaaagcatttatttgcccagtaccccacaagtgatagaatctgagtccagaggttcggccaccagggctccagggcctgaggttttactgtgttgtgtgctgtggatgggttactatatcctttgacataaatatatacatacttggcttatgtctgctttgtccccagaatgcacacatatctgtggttaagacagtgttccttctttctttctctctcttttcctttctttgcccctctgcactggcattgaactctggggagaagacacttgcgttctgaggctgtttctctgtctctaaatgaagacagtcaaactgaatcgtttccaagtccccgtccagcatttaaattcagtgtaagaaggaactcctggctacgctgccttcctaacctggtcaaggaatgttcattctttgtattgactgcagtgtcattgaatttgctgcaaggctttacatcctcctcatgaagaggtgaccttgtatctagagtcccttcgtctctgtctttgatgcagtgatatttctcattgtgagtgattccataagctagaccagcagttgcccatattccatggttgattagttttctagaaaagaagaggacccttcacaatcacagttcttgtttggaaacccaacaggaccttaacatgtattcaaagtgctgataccaaatgcctcttcttacttggtgcccactcctctgcacacaagaacaagtgtttttttcttacaaataaccacttttcagttcattctagtatcacatggtttctagacttctttgcaatttgagtggaactaaactacagttcattgacaggcatcacacagcacgtgtttatagagattaacagaatatctctgccctggtgacattggtagaaggctcattgagatgattttactgtgaacgacgtgaatgccactattctagtaatagtgttcacagctgtatcaatttatggcttattaagtgtagggccaactaaataacacatatttttctacacaactgttgtcaagctgaatttgttccttctaggaaatagtacaacctaatttttcatctaaagatagaggtatacctggtcaaatccttcatagcaagaaagatactactgctagtatgaatcttgacttagaagatgaaagaagctcaaatgttcagttgttccaatcctttgaatttatagctgagggaatggaagtccatcaggagggcatgaagcctgttcaagttcacacagaggatgtggagcctctgatgctcatcgctgtggatccttcccatgcctttatcccccctctgcacacctcacatagtgtcatgagttcctgttctagagctgtggtcccctgaagcaaatctacgggtctcccttctcctgtcttttccttcctttgtgtgtgtgtatgtgcgtgtatgtttgagatcaatgatttctcttttgcctacttttgacttaagataacatttgttttggagctcgacaagcatgactcagcagtgtaacactctttttaattttaattattattattttatggttattcttttgtgattatcaagttgttcttgatgatatctgggcactgtgcaagacttccttcactgcatgggagtatgtgaggttcatttcaattgcacttgtgtttccatcttcttcccttctatcactgactcactcaaagcttgcttttgtttcataaaggatcaaccaacagaaaattgagaaagtcagtccattaatttgtttggccagttttagtcattggttggattcaaaataccccatctattcaacccagatggaaagaactgaccttttctgaagctaaaacatatgcaaaatggacaaagcccatggcttgacctgacctattcctaggtcatggtatcctgatagagcattctccccatccgaccctgaggcacctgaacccagcaacctctttatgcactcacattttcagccttaagggtcttccctaagctccgctttctgagggtaaagcctttaactttcctttgtggacaaattgctcactagctcatcattggggttcagtggacaaggtatccttacatgccatctcttcatgagggcgtgaaggctccgttcgtaaagaactatgatgtggtcatgtaatgggttcactttaagacttgaaaataagtaaagcgaataagttacactataattcatcatctttcatatatagcagtaatgcaataatacaataattactttggtttttgttggtaaattatataaatcattctattcattagagataatgaaaaagtaacacaaacatgatgtgatgtctcccttatgctactgatttactttatttcagtcccgcctcacttcagaatgcaattttttccttgcaggaattacttgtaatggcagtggtagaaccaggggatcaagatatccagcttctgatgcaggaaatccatctctctttattgatagcccagcatcatgcttttatctagagaggcatttatccatctaaacacccctagaaaagctatgtggaaaatgtaaaagcatcaggaagctcaaagttacagccaaggcacagactgaatgctttaaaatcttgtctcatccacagaaatccacaaagattatttccatagatcaaggacatagtaatgctgtttgccctttttacatagtagtaccgtatatttattagctctattgatgaaaataggagagcaactctccttgatattagagaccttggcaaacgtaaagtacttaaaaaatgaatagactgccttccgaatgtgaactcactgactaagcccagtgaaaggagagtatggcatgaaatcagagaatgatgaatggccaggattacgcgcgcgcgcttgtgtgtgtgtgtgtgtgtgtgtgtgtatgtgaaaataaacaatatgattagtgtttattctttttaacaatccacaaattgcctgcttttctctacttttttttttgagatcaagcctcactctgttacccaggctggagtacagtgggtgtgatctcagtgtactgcaacctccgcctcacaggttcaaatgattctcctgcctcagccttgccagtagctgggattacaggtgcccaccaccacgcctggctaatatttatatttttagcggggggttgggggcggggggattcaccatgttggccaggctggtctcgaactcctgacttcaggtgatccgcccacctcagcctcccaaagtgctgggattacaggcatgagccaccttgtctggcctctactttctccagttagaaagtggaagaaactgagcttcaaatgtcttgcttacagctattttggggctctgagttgagatttttgttgtaccatttgtgaagccatccaggtgctgggtctaatcattcctgggcaactgagatacagaaggagccccagctcagatggtgcacgggcacatcataccctgggcattatttttgccctttttctggaagtacgattggaaatgggcagcagatggaccacttcgcattttacccgttcaagcaaggggtatttttcttctaggaagtgggatttccaagcaaaactgccgctttggtagtcacttgccatacttcagtgtccatggaaaaacaactgcgtataggaagagggaagggggacatagcgtgccaactctaactctgatgtctgcaccactcatccataatccatgtcccagtggggaaggtgatattccctggcatctacagacccagcaggcacacggtgggtgagtgggcctggtcacctgcaaccgcagtagaaactctatcccaaggcaaaaggaaattaagaaatccatttgtgaataatattcacaactacaatactgttttgttggatctttcttagtttcttcagttcaaggttgatttgtggcccatgagtctctgatccagacatttgaaaatctctagactcagtgaaagtcatgttaattataaaatcagtaagtacactatacaagagcagctttgagcttggtaggaagacggccttcccaggaaccagagaggagagagccagctttgaccctgcgaggcacatgggagaaaagagttcagttggtttatattctatgaatttactttccccattggtattccgaagtgttcactgaaacacagctgctcctggcactctaatagacatttcccaggacctcatggcagccttatccacagtctccagcctgcagtcacatgtatttttcaggggttcactgttagccctttgagcaaatatttatagagttgtttttaaaaaattactgatgctgtaattaaaaagaacacttaatccaaattacttaatagacgaataaatgagtgaataatcaaaacatttaataccactggtatatataagaaatgaattaatttcaaagtgtggaaaaattatgtgggcttcttatcagtggtattaatctatttttgatacataaaccaccctaagaggttttcctatctatcccaagtgtcattttgcagtattagtttctctaggatgtgttttcattagcctcttagatataaatggctataccactaaaatgtaggaaaaatcccaaatgaaagccctttccctattcaccctgttaagcttcctcttgatggaagctctcttcacccttgaaagctgctaggaggtaatggagggcactgtggccacccagccctggtgcactgagtacctttccttaataaatcaccgttggagtcctatggcaacaacctaacttgataacacatatatctagatgtcttgcttcattgatatgacagtgatttctcttttcatactcaccttgggaatctaagatgttagaagctaataaatcccccacacataaaacatataatgatacattcagagaaagattctctaaactgatttcagcagttcttacatataatagaaacacagacttgcctaccatgattttgttacttttgttgtcatagcctcattcattagtttgacaaatacttgttgcccatctcgagtgttccaggcaccgtgacaaacactggttatgaacagcaaaggagatggaagtagtccctcctctcaaggagtctgtcctctactggggagatacagggaggtatccagcagtacagcctgtctgtctggaaggagcccaccccacatgcagttgaaaaacacagcatggcagatttttcaattttaaaaaaaaatcacgtgctgattttataacagattttaaatatgacctaccagtagattatagttcatcatttttgaaaggcactgttgttaacgatgtagcaccttcccgtcactggtatctcagtagccaccagtcagagcagctcctagcagactccagaatcatgttaatatcttccatccgatcacctctctgaagactgtttgtagataagtgtgtcttaagtgaactttattcgaatgaactcctaccctgtagatgacagtttttgcatgaaccgtaatcagacatagatcttcttagggaacatataatggggaaaataggacttggccagtcatggcagatgttcattgatgtgtgtcatatgaatagatggatgaatagcacaaggtaaagagtggtgtgttttataaggcaggcacatgcagatgttatgaggacttggcaaggctagtagtaactccttaaagaatcatggaagacctcaaaagccaggaggtggtgtgtgagctgggctttaaagtaagcctatggttgtgccatctggaaatttaatttcacaacatcctggaatgtgtttccagtgaatgagtcaatgaaatgacagaagtcagtggacaaagattactgggaattttcctgcaagatgcagcactcagacctgggtttgaacccaaactctctcctacttttaccccaggacttttcccttataagacaatgcatgtgaaacgtatggttataaagctaccccaaagtagaatcttttattattcttcagtaaaacccttcatgggatgagagtttacgaataaattcagagttcatctggaggtgcccggtggatctcttgatgtcctagcttcccaggtacattgccagtttacaggaaaatatgcctttttgaaactgattgaaaacaaattagctgggttttcttggacgatgaatctgtagtttttcaaagatcagaaaattcctgttctccaagaagacaggtgcagaagtgatcatctgaggctgctctccaaggtcctcagtgtatttgcaatttcctcagagtctgtcagccatcacagcatagcctctttcttttttctggatttcttttttattccatgataggtggaataaggcaatctgggcccagtaatgcttgttttttaactcagtgtcatcactatctctcagccagtgttgtgtcccacccaccaatggcccagtgaaaagtgatccagaatcccttctgaatcactgaattatttgcacacaaactcatctatctgatctgtccatcctccatgataaacggaaattagtttcattttctgccctccccttcctcctggaatatctgactcttcaataaatgagaagacagagttatggttcatttactgacttgattttaatatttcggagagcatttaaaacatttatagcgcagcagtcttccttttcataggaaacaaaagtcttctaaaaggcagtctcatttcccgtgtggttagttgaatacagaaaccgtgtagtcagaaggaaggggctgccctgagtcagcccgggctcccggggctggacggagcttgcatttctgagctcccagggcgcccccaagtggcgatgtcaagctccaagttgttctcagtgtgctcaacagcagcgcttttataaggttctttttgttttgttttgctttggctttgctgttgtttgttcggctgcttttatttttgcagttggctgaattcatccgagggttatacaaatcaaaaactgtaagtggagaggatctaccagttgttttgcaaagatagaggtgctatcacggaggatgctgttggtgtggcataggtgggaaagagaagcagtaagaagaaaggagaataaaagagaaatccatgaagctgtaagaagtgtttttttgtcactttttaatgctgatttattcacctggatcaaaataaggaaaaacacacgaggtctaaatcatcaaaataagttgcaagataaggcagcacgcttcatgaggctgtttctcttgctttctgttctcaacaccagttctgtgtaagatgacctgcaacatagactctgcatgtagaatctgttagtggctgacccctgccttatataaacaaggctggtaaatatggagcgaggctcacattcaaacaacaattctatgggctggattaagactcaaagtccctaaacactcatcaaatcatgttgcctctcccatatgcaattccagaaggataatttattttgttaactaataaaagcaatatcatgtgtgctgaaagtattttttcccacatattctgtgtacagaattctatatatgttcctaggggctggaacatttttcctttaactgtgattcttattctgattactagtgttctgaatgcacacttagcctgcgtgctacatggcctgtgcagctctttcctcctgccccgggaagaggatttcaagcctgtcatcttcaactcatagcagccttggtggagtgggttccaaactggctcttatgatgccagctcaaagtcagcctcttgggagtctctttagggcaacagggttttgcctttcaacacaacttaagtataaagtgcagataaacataagagtgttattttaaaataaatttgctaaagcattatttctcttttcccctctccctcctcctctgtccttcctctaccctcctctttcagactcatactcctcctctgtggctttacaaatcctggatagaaaacatctcacaaaacatgttctcttctcttcacatatttaagaggccttcgagcattgacacacatttgcctccagattttctagttgaagaaatgtgcaaaaatcaataaaaagcccaaatacagtggtatttttccccagagttatggacaataacaaataatcaggtgggaaggcttgatgattttctttttagattgtgagctacaggcggccatatgtgttttaaaggttaggtacataaaagaagttttgaggtttcccctctgtaacaactgattggccctctcgggaactctgtgcttaaataaagctgataggattggcctctcttagcatgcttatgccatagatgagcgtctgatgcttagcgacctatcctggtgcaagagccaggcagtggaagaaccaggtgtgcagtgtgtccaacaggaatgcttttggctgtgaaacaattcctggctgaaagggcctaagcccgggggattttatctgggtgggaagaggattctggttttagttcagtacctgcatgctatcagggctcaaggtgtgcatccttgcaaacactggccccttcttctcatgtttgttttttttgttgtttgtttgtttgagacagagtctgtctctgtggccaggctggagtgcagtgagtggtgaaatcctggctcactgcaacctctgactccctggttcaagtgattctcctgcctcagcctcgcgagtagctaggattacagtcatacgccaccaggtccagctaatttttgtatttttagtagagccggggtttcaccatgttggccaggatggtctcgatttcccgacctcgtgatccgcccacctcggcctcccaaagtgctgagattacaggcgtgagccacggcgcctggcctcttctcatggtttcaaaaaggctacagcagctttgagcatcaaatcctcacacaactatgttcaaagacagaaaacaggaggaagtgatgttggcaggccaggggaggggtccctcctctgaccactctctcttaccagagagaaaaataatctttgccacagcctcccagaaaactttttatttctgcttcatcaagcggacacccttaacttgtggatattctatattggcaggtaaataagtgagaagggatatgggtgcagcacgggggcaaccaatgaaaggttggccatacaagcaggtgttccaataagacagaagaatacatgaaccatgctcacaggaaaatttatatagtttcctcttggaaaacaacaacaaaaaccttctggtcttatccaaagcattaattggatgaaaaatgtcaagcttttctcagtgttcggtgcagtacaaacgtaggattatttctaagtggaggagcaatagaagatagcactgtagaactcttccgtcatgccaagagaagttagatatgaccaatacgatgaagggaaatgataaggtgacattatccctgagctaaaagtcaccgaatctgtgacaaggtatgggctagtcaacttgtggagctctccagcccccttctcaatgaagattttaaggcaaactagaattgcattacatttagtgattatttttcctcaaagaccaacgacttcaatgggagatagaagagtctgtggatcacttgcttttattctcttcctatagctgtgaaaattgattcaagaaattgccaacattccactttaatcagggtagaaaccaagagttgggtgtagtttatccattgagatgctctatgcattggcaatgccatcatttaaaaacatcatggagactgtttttagtcatatggacaaatccaagcaggctgccttcccaggaaatcaggagcaacctatgaagttctaggcttgaagttttttgattggtggacttaataaaatgtagatataatcagtagattaaaagtgagtactggctgggcacggtggctcacgtctgtaatcccagcactttgggaggccaaggtgggcgaatcatctgaggtcaggggtttgagaccaacctgaccaacatcgtgaaaccccgtctctaccccagctaaaaatacaaaattagccagctctggtggcgcatgcctgtaattctagctacttgggagtctgaggcaggagaatcacttgaaccgggcaggtggagtttgcagtgagctgagatcatgccattgcactccagcctgggtaaaaagaatgaaactccatctcaaaaaaaaaaaaaaaaaaaaaaaaaaaaaaaaaaaaaaaaaaaaggacctattccaagattttcattaaatgctcagataagtataccacccgaggatcagtattataaccaggtatcttattggaagtcttgtgttttatcttggaatactcatgagttcggtattccatctcctggtatatttggattggataattttatgttatttgataaaattgcctactcaaggaagatagttatcctagggatttgaatatctcaattgggaaactcagcattcattgagaccacaatcaaccatttacatctcattttgagttggacttgaagttgtggatgatatcagagccctgagagagagaaatttaaaaaggaatcctgaaaggcagatgtaaatatcgccttacactgcttcttcttttaccccaagatggctaagaaagccttcaaagtcctttgaaagcattaatttatccaacttttcccacaaagactgaaatgggtctgcatcaatgatgtaatttgggtattgctgggttatacaggagcacaatggtgatgattatgggtgcgctgcagaggactgagttaatggaatcccatcagggactcagagcacaaattcggggcacaaacaggacccacctcatcccgctgcagctgagagtcactgttgttgctgctgtgagtgagggaaaaggctgatcaaattgcaggctcatgtgactggtggatttatttagccaatgggcaatttcggtgtacctctcaagcaaaatataagtaattgttgagagaattacttttttgattaccaaattactatgatttgaaatgcaattagtagtatagacaaacctatttttcccctttatgagaaggaaattgttcggaaatgggtatagtggtgctgataaagttacagtccacagtgaattaaattacccacaagaagcagatacatggtttcatttcagttttattgctcctaatgcaatttgttttcattaatgagaacccacatgtatgcatgaatcagggttttgcactgatacctcctgtgtggggtatttctttttccaggttaggtttcattctccatatttaagatctattgtgtgtatattgatatttgcctataaatattaaagatgcacctgtggttcagagaatatgttaaaattcaagaaaagctaccgatctacctaaagtagcatcaactcgttttttaaatttgtagatatttccatttgtacatggaaatttagagggaatcttaagtgacggtgaaaaataaaatggattttataatgaaccctttaacatgcttgaaaggagtggattcaggagaattaagttcatgaaagtcaggtttgaactttaaatgtttattaactttattgatttttaattaaggacaggatttttttattgcattgaaaaagcaatgagtccaaactagaggcacggaagattttttttatgaaatcagtgtttgaaagtaaggcttttttttctttgcagttctgcagagttcttctgccaaattgcatatgttctggcaagatgggaaaaggctctctgctaaggtacaaaatcagagtatctcagataagccacaacagttgtggtatgatagtttgaccatatctttgcctttgctttgacaattcccttttgatttctaccttcttcctgacatgaaacttaaacatcagttcaagggcgaaacagcatctgaaaatgtcctgcaaagactaaatggactgcattcttttttgattctgaataaagtcttagaaaagataaaaaaaaaaaaaacactccctccctcatttaaatggtttcttttttttattcttgaaaaatccttacccttaggagaatccttgtccaatcctttaaatgtataagctgttatctgagacctgagcaaacatttgagaaatcttccaggtcaccttggtgccgtgaagaaaattgctctagtacattgctctagtgcagtggttctcagacttgtgcatgcatcagaatcatctggagagcttgttaaatgcagcttgcccggccccagccctgagtttcagctggtctgagacagggcccacgaatctgcatttccaacaagtccctgaatgatgctttcgctgttggtccagaaacaactctttgaaagccactgtatgagtagattaaaaatgctacttggtgctgctataataaataaatcacagctttattgtgaacacatttgcaagctagtggtttctaacagtccttttgtagtaagactagcagtgctccaaatgtaccaaaaggagcaagaaattgagaaaacggcatctattcacaaaagtaaagcattatcagtcggataatttgtagtatcagtcttgcttcactttgaggagtactgatgatcatctgcatgaaagcaagttcactgtagttcatgatttcatccttagaacgtagcgcaatgaatggcacatagtcagtgctcaggtgttaactgaataagtgaaatgcctacaagaagcatggacttgaccatgccattttttcatgcattgatttggctttaatgacacaagcatgctgtttaaccaattatcctcagtgacttacccaacaagtatttatttcaagacccacatttctgctggttaactgtgattcagctggtctacactgggctcggctaagagactctgctttgtgctccccaattatctggcttagccccaggctgtgggttgtattgaggtcttctccaagtgtgtttgttctggggccaggctaaagcatcggctgttaatagggacatgtttttgtatggtggatcatcagagtgcagaagccagctagggtatgcaagcagctgcaaggcctctgcctgcatcatgtccacgcacatcccattagtccaagtaagtcacatgaccagtctcaaagtcagggtggcagtaggtgtcaggggacaggttaagatgcttccctgcagggggcatggggtggagagtagtatttgctgaacaacattccagtctgttacagtttacaatatggcaataatggcttattccatttagaactcaaagatgagtgttcaggagctggatatttataggttggaaatgcaatcacatgctccgctatattatgctcttgaaagaagatgctgctactcagactgtcccactgaacatctgaaaagggggtttgtcacgtaaaggaagactctttcctcttccctccttatgtttcacagtcattgtgttgttggaagaagagatggaaagatacactggaatctgcagtacttggacctgggggccaacttgctgggcttttcttattttgttatttctggccgacaagccttctctttcgggggtgaattaagttgtgctcacactcaaccctccctaaatcttagtccagatgcacattttagaaatacactatacccccttcctttatttgtaactgcagtaatttttagtgaagtcaagttttccactctctgtaactgtttctattagcctgcaggagagtaccaatttacgtggcaggatttattgagttgacactggctctgtttgttttgctgtcaggaaaagacgttgcatttgactgaccctatctttatccattttggttttgctgttgctttgaagtcaaagcctgagaatgcctctgggctgatgccaatgtccccagaagacagtgtaagcccttgttccctgtggctcacagtcagttctaaggctgaccataccgcaagcaggacttggtccttcacaaggcatgccagtggtcagcagagagaacagacacaagctttctcttctttctgaatgcaaccatcacctctcctggttacaaaattaaagcactgaagtgcagagactcattcctatcactttaacattgaagggaatcatatttaacttaattcacctgaccctaagaagtgtgtggtttgaaaagggcaaggcgctctaggggcactttggagcagaagtcatatctcgtttaatctaatacagtttgatctatgaactaagacgttttggagaacaacatggttatggtcaaatgatcaccagggacaaacagaaagagaagagagtcttctataccccatgctccaaaaacctaagagccttgggaagcactgtggaaacgatcattgtgtcaccagaaaataggaaatgacaggagttcgtgcctcctccagggtgagaggtgattatttggataatttctgaggcaatgttggtagcacaaggcaagatttgataaatattcagagggcagcaaggaagttttagagaaaataatatatattctacgtatagcctacagatattgatccagagaagggacatgcatgaaggcaagacaacagaagtgaagaaaggtagttagaaagtgggaggagaagagtcgattatggttcaatgtagaaaggcaagatgaagaactaggggagaatcctagaggaaggtggtaaggttgtgagcagccctccgaggggccacagagaaaacatgggatgaggttggcaccagccatttgcgtaggatcaaaagcttgtgcagctcacctggcgataaaccttaacactcgtgttaatcaaccactgtgtttgtgtacatgacactagtgtagttagttgtacgtatgttttgaactgtgtaagatccaagcagtgacacaatggtagggctaaaatgcagagacatgtgctattgggagattgaagcttaactttactgatgttagagaaaggctatttattgggttacaacaaatgattttacataaaacataatttttaagtattaagttgaaaagcccaaattgacccaattcatactttaactctgtttttcaaaagcctgaaatagcaattattgtgtgtgtgtgtatgtgtgtgtgtcctggatatttcctgtttgaaggtgtgtaaaaggtcttactacccagcccctagtggagagttctcttgcaaaaaacaaaaacggaaacaagaaaccaaacatgctttgagagatagagagtgagaaacagattttcagagtggagaatatgccttctatttatgcatttagcattgtgttttctcaagctacccagattttttaaaatttctccccgtttatgagttcaagctgataatatgtaaaagacagtgatgcccactgttttagggaagaccttccttcagagtatgctaacttagccatttcatttcttcaaatattagtatttggaaaagaaaaaacagtcttaaatatggttctgtcctccctcagcacccagagaaaagggaagtcaactacaggatataattctctcagaaataagaaaacctcttagctaataaaaatcatgcttaggctgctaaactcaatggatgtacttttgttattcctacaatgcttagcttgcaggtagaccaaaaatttgccttcattgtcattttaaaaatgactatccaacatattttgcagcatctgcctaatcccaatgacttatatttgttttgtaaatttgttctagggaaaataaacacacacccacacctttgtaataaatagggaagcactaatcatatgaaactagatagaaaaatgggttgggggcatttggtttggagcagcatggaagaattaaactcgacattaaataatttgcaaaatattttcaaaaatattttctcacacttacccaataagtaggaataaaaatctgcttcatcgccacagtgtacttcaggcgttcaaggagaaattgagtagagggaaatattgacatgtttccttccgaaccactacacctattttgaaatgcccattgggtacttttgctcctcttcggggtatctttttccttgtttgtgtgtgtgtgtgtgtgtgtgtggataaggggaggtgaaaggtgattagagacaagaattgaattaattatacatcataaacataacatgccatagcttgccagtctttaaaattgtatcacttcacttattctaacatactaaccactttatttttttatatgtgggaccacagtgtcctcacaccctcgactgcaatgtgtgtatccgtgcttaacacaaatttggatgtgtgggtgcataaacgtgcatgcacatacacacgaggtatagaacatttatttatttatttatttatttagagatggagtcgtgctctgtcgccaggctagaatgcagtggcgcgatctcggctcattgcaacctccgcctcccgggttcaagcaattctcctgtctcagcctcctgagtagctgggactacaggcgccaccatcacacctggctaatttttgtatttttagtggagatggggtttcaccatgttggccaggatggtctcaatctcctcacctcgtgatccacccgcttctgcctcccaaagtgctgggattacaggcgtgagccaccgcgcccggccagaacattctttaaaatgtccctagaagcaccgcgttcagtgtgcaaggtgcaagagtatagccaagcgcttttcaatttgggtaaagggcgctccatctggatcatccttgaggaacatcctcgtgttcatccatgctgtttccagtcctccccagcattccggctcctttcacacctgcatctttcagacgctcgctctttcctgccctccgtttcttctgcttaattgtgagatttgcttcccagcacaaatttttacttcaactctttcccctgttgcttatgagttttatggtgatttcattttataattttaagcagaaatcgcttatcatattttcttagataatttaattgagattttaaactttagttagattacagttacctacaatgccttgagaatatagtttttaaaagtggcacatatgctttatcccaatagtattctatctatgattaatatgcacacatctatcattgtattttgtataaactatattagtatgacatttagtttgtgtaaaaatatgcatgcatatttcatagatagcgtatgtatattacataagtgggaccctaactgcatctatatttagtgaaatgtcaggatcgcgatgctgcggtgaatagcatgagctttctttcatgtccatgttaggagaggcagcttcctcccatcaaaagcacagctggggcagaggagggggttgagagcaaggttttctatctatctaattgtggtgacttttaaagtttagttttatggctctgttgcctctgtcttcaaagtcaaatggagcagctgaagctctccccaccccagacccacctgcctggcctctcccatgcagcaagtttcgcttagctgttgcaatcctggttttacttggttttgtatttgctattttttaaagtgtttttaaactcatgtttcttcatagtaaagggtaactactgtggagtaaacagaagatgagcgtggtacaaattttggttaaaccaaaaactacacactggattgaaagcttggggaagggaggcaggtggaagggactgaaggaggtctcttcccaggagacttgttcaccggcatccagtattctcccccgcagttagggaaacagagggagcatgcagtttcaggcccaggcaggcctctctctgggcttggggcaatgccagggctgggggcgagcctgcagtcagccttgtgagtggcagccgaggctgttattttgaaaccctaagtggaaacaggcatggaaacccggaaggagcagggagccttaggcagtcctgggagatgaagccaacgccctacctccatgtggaaggaggcggcggaatgggcagggtcgggtctcacaggttcccccctctggagttggggtttcccggcccacgttcactctctggatgtgataggtccttcccggccgggaagggctggaaggggcgcgcaaggaggacgtggggacgagacgagagagacgcgtgcccagcaactccagaaggacggagaggagtgcagaagggagccggggaggacgcgggagggccgggaggggaagagaagccaggccgggcctggagcggaggagcggagcccgctggtgcgggtgtccacacaggggcgctggagcgcgccttcctgcggctgggcaggaggcaagcccgagagcgcgcggcgagtggagccatgtcgccctccctcgctctcggcgggcacagtgaggcgcaggctttggaaaagttgcgggcagccggagagccgagcctccgcctgcgttcatgataatgagaatggagtcgcggtcacagccgggctctctgcggggcgcatcgcccgcgaggggcgcctgggcctctgggcgtcctctgccgccccgcgacctttcctgccctcctccggagagaggcgaagggaaggggcggtttcggagggagctgggctgtggagggagggcggcctcttcaccagcgtcgtccgaccaccccgcgccctcctggtggctctcccacgccccattcgcaccccaggtcctcggggtgtctctggtgttgcttcaagttaggcaagaggagctgggggcgcggggagcccggcgccgcagcgcgtgcgtggctggggcgccccggggccggctgcaccttcagtcgccccctggccggcctgcctgcctcgacctccgcatccccttgcaccgtccgctcgcgtgctgcggggcactcgcagcactaccttcggtggggccgcagcaccctgagctcccgggactcccccaccgcccccgcacccacgacccgcgtggtcccagcccctccaccctcttcacgcaccctcgcacccttttgtgcgaccccgtgccctctccgggctgccaacccctgccacccaggtgccagtcccgggcgcggggaggaggccggtggggaagggggcggaggggccggggtggaggaggagctgcgcgaggggcctgggggcggggagcgaggagagcgctcggaatgtgtgccggtctctaggtggtgccaaattctggggcctaggcatttccctcgctttatgtttttggttttttttcttccttcaatctctttgattaggccgtacgtggctgtggcaaggagttggggaaaaaaattataaaaacaggaaagagagaaagcacagccagagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgtaagagcttctcgggggcggggggcggcggcgggttctccgggctgagcgcgcagcgagacgcgtcggcaggggaaattttttttggggggggaatcaggcgccctccccccgcccacgactctccgggcgcccccagacaggctccgtggcgccagatcgcggtcaccgcgtcccggagggagcgggtctgtgtctgcagccgcggcggccgggagttggtggctggagagagcggggtttgggtactgcgcctgctgggatctggaattcgccttacgttccctgggtgcgcggatgtctgtttttaacagcatgctgctatggttcctaaggagagaattcgatcggcctgtgcttacgagttggtttattttttatttatttcgtgctccgggaacacagcctcaggcaccttctctccctcccacctgtgtctggaatctctccatcgtgcccctcctctcctactcactctgtcccttgactcaaatgcctctccttcgttcctcttcttacttctcctagacactttttccccccagcggtggtgatggtgattatcctttccggaaaaaaaaaataccaaaatactggcatctgagccccaaccctctgtcccagggcccagctcttttgctgagagccctcaggccgtgtctgtctcccctcccagccctggactagcacctctgccttagaccgtgttcagtgaaaacttctccgagagcacatttcctactcttcatgggggctggaagcctgggtttcaaaggttggatttgcacatcgccctagtaaccaatgactcatgcaggacaggagccggaccttagatggatgcgtttaaccacctcctgtggatccctttcaaggatgcagagggctgctaggacttagaagggaggaaactgtgctttttctttgaggccttcttttcccagggaaaagagaaaaatccccgacaggctctcagagaaacaggtctggcttggctggtacagctcttataacagctaggctgtgttggtttgtagaaattactatgtatgcctttgaggagtttcacaactgctcaacctgggaaccgcaggggtcccaccggcctctcacttagtctaccctgacatacccagggcagtacattgccgggcactgagtaggtggttttggtcattacctctctgcagcctccagccacgctggttccctgtttcgtatttctttagtgcaagagttgtgtttgggtcgagggaggggtgagacattgagtgatttcccagggacaattcctaattgccagatactatgaaatcagtgaggttttgctgttgttattggtagtttttgttttatgaatgaaggatgtggaaactttaatggagatcacaaaactttgtgggagatgtggtttgcacacacacaggtacacaccccctacagccctgcgtcagattttgcatgaggttttgtgattttctcctgcatcgtttccagactcccctggttaaatagtcattcaaaggcatgtccctcactttggtgggccaagccctgagggaaatagacagatccttcagtcatctggttcaagtctttggcaaatggtttaattgggggagggtgaagagttctggaggattaaactaccgagaatcttggggaagacagttaagctgcaatgcaaacaggaaaaatgtactttttaccttaaatctgacttaaaattgttgaattgtggatgtttggaatgagaacaatgtgcagtttttttctcaacaggctctaggtgtcgctaggagaaaggaaaggcaagagctctgaattttatttcagatgatctccatctttttttaaaaaaatcttaacttggagtatacatgtccttctttttattgtgacatgtgtctagaaatgattctcagataaacacaggtgtcctgagaaacaaatcagggatataacatgtacatttgttaatggggttctaaacagcatctctaacttagatgtaagtcctgacatgctttttttttttttttctggaaaatacacaatgtgtgtgggtgggcgtgtattgtgtgtttatatagtgtactcccgatatatatatgcacacatatatacttgcccattatctgcacatatatatctggcacacatctgcaaaatgcattgcacatatgtcctttaaattgtataattaaactcatgacacaggctgaatgttgcatcctttaaaaacaacaacaaacttttatgcactcttcttagaaaagttcctcagaataggaaaagttatgcccccaaatttactaaaagatagatgaacatatcaaaccacttttcctccaggaacaaaagcttcaatttgcttaaagtgtattgaaaaacaaaaacaaaaaaagagattaggtagaaaaactgctttttaggtacagatacttgccaaggcaaggctgaagaatctagagtaatcattttgctacccaaatttaaagctgaggatatgcaatgaattaggaacacattgcattttattacgtgtcttgcaactgctgacaacctcaagacaaaccgaggctttccttttccacatctgcaagcagctgggagcgccgctacttcggtgggagctgtctgaggtgctgaaaccttctcttggcttagcgcaggagaaatctccatcactcttgccttttcagtcctgatcccaaggctggtggctttatcgctgttctctggcttgtcagggaagactgttccaaggtacagaaacagcttcgctgccttggtcactaagatgatggcaagcagcatacctttataatccttaggactttgtacctgttgtccttctgtctggaaattgagaaatatagttcttggcttctgtgcatgtgtgtacacctacatgcctgagcatgactgagaatgggcaattacccagccacaacccaaataaaatttatggtagtctaacaaggctaacacagagaaataaaatgcggagatagaatggctagaattaataatgcatggtctaaatgcacaaactacacaggcaacaaagggacttcccaactgtgtggctccacaggaaagcctgttttgggtgggtcagtactaacatgcaaagtctgacttcaaaatagaaataaaaccagagggtcttctctatccacttccttgtaaatcttagatttatttaaatataaagtcaattacttgggcaactcctctgaggaatcaatagcccttctgatttaaaattcattgtgtaggtttaaaaataagttgactcttaaaggaattgttgctggaagtgacttttagtggaatgtattaactttcatttggattaactgtggctaattttaaaatactgaactttgtcatccgcctgcttgaacatttctttttagttttttaaagggctttggaggccttctgtaccattagagcagtagtttttttaaggttatacagtgtgttcctgtatccttcattttcagtgacacgtggcttcttagcaatacaaatgtgatgacaacaggattttaaagcagcaaattggttaaaactgggatagatgggcaaatcaccacccatgatgtccaccagccttggaagggccaatttcatcatccgctatgtcttcggcaaccaacccatttttttcctccaccttggtttttcattggtataatgtcaacattctgttaatgtgtccttgggatctatcaactttacgatttcttaactagcttccctctacaaatatgtttttatactctattacttttcttctgtttcaactgtaatttaaaattttttaagtttcacatgattttcctgataaatgagaaaaagtctaaatctttcaactgtctatttgatcccattactctcatcaccaataggaccagtgcttggtgtactcacctacagaatagctatggatattgcaggagcatggagagttgcaatgttgccctctcttgatcccagtggcccctacaaagtgggagccatgaggccaggtactgagaagtgcccagtgaatacatgctgctgctgttactaataatattactgtttctaaaggatggccaccctgtttgagggccttggcagcaactgcccagctagtacaagaagcaaaaaagctgactcttgggcaaaacctgaacataaaggcctcccatttcgtggtggttgagagccagcccctcttccccctctggctcttgtgacccccatcacagggtggggagacaccccccgcgaggcggggactgagagccagcccctcttcccccactggcttaggacgcccatcggggatcctaagatccttaggacccacctggaggactgtgggtatgaggtgttcaagaagaaagctcaaatcttccgacggcaggtaccttgcgtgggatttacaatacgacaggggtccgaacgcagctcaggaacagaaagaaagcaggttatttgcaatctaccggagcttaagggcagaaggcaggtgagagaattcttaggagctgtggggttttgtaggctgtggatcccaaacgttgcagtattagccaagcctttgtatgaggtcacaaagggggcggggacccggaacctttgaaatggggatcccgacaacagcaagtctttcattagttataagaaaatcttctggcagccccagccctggggctacccgatctgacaaagccttttccattgtatgcgtcagagagagaaaagatggcagctggacttttaacccaaactgtggggccctggctgaggccggtagcctacgtctctaaacaactagacagggttgctaaagaatggcccccctatttgagggccttggcagcaactgccctgctagtacaagaagcaaataagctgattcttgggcaaaacctgaacataaaggccccccattttgtgatggctgagatccatcccctcttcccccctgactcttgggactcccattgcgggtggagggaggcatcccccatgaggcggggactcagagccaacccctcttcccccccctggctcttgggaccaccatcgcagggggggaggcaatccccgcgaggcggggactgcgaacctccccctttcctcccctggctctttgcacccccatcgcagggggggaggcacccctcgtgatgcggggactgagagcgagcccctcttcccccctttgctcttaggatccccatcgctgggggcggaggcaccccccgcgaggcagggactgagagccagtccctcttccccccctggctctgaggacccccatcgcaggagggggaggcaaccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggacgcaccccccgcgaggcggggactgagagccagaccctcttccccccccagcttaggacccacatcgttgatcctaagatccttaggacccacctggaggactgcgggtggtaggtgtccaagtagaaagttcaaatcttccgacggcaggtaccttacgtgggattactgagagccagtccctcttcccccccggctctgaggaaccccatcacaggagggggaggcaccccccacgacagtggggactgagagctatcccctcttccgcccctggctgttagtacccccatcgcaggtggggaggcaccccctacgagagtggggactgagagctatcccctcttccgcccctggctgttagtacccccatcgcagggtgggggaggcacccccccgcgaggcagggactgagagccagcctctgttcccccactggctcttaggacccccatcgcagaggggggagggaccccccacgaggcggggactgagagccagtccctcttccccctctggctcttaggaaccccatcgcaggagggtgtggcaccccccacgagggtggggactgagagctatcccctcttccgcccctggctgttaatacccccatcgcagggtgggggaggcaccccccgcgaggtagggactgagagcctgcccctgttcccccactggctcttaggacacccatcgcagaggggggaggcaccccccttgaggcggggactgagagccagaccctcttccccccctggcttagggcccccatcgttgatcctaagatccttaggacccacctggaggactgtgggtattaggtgtccaagtagaaagatcaaatcttccgacggcaggtaccttacatgggatttacgatccgacgggtccgaacgcagctcgggaacagaaagaaagcaggttatttgcaatctaccggagcttaagggcagaaggcaggtgagagaattcttaggagctgtggggttttgtagactgtggatcccaaactgcagtatgagcaaagcctttgtatgaggtcacaaagggggcggggacccggaacttttgaaatggggatcccaacaacagcaagtttttcatgagttacaagaaaatcttctgacagccccagccctggggctacccgatctgacaaagccttttccattgtatgcgtcagagagagaaaagatggcagctggacttttaacccaaactgtggggccctggctgaggcccgtagcctacgtctctaaacaactagacagggttgctaaaggatggcccccctatttgacggccttggcagcaactgccctgctagtacaagaagcaaataagctcattcttgggcaaaacctgaacataaagggcccccattttgtgatggctgagatccatcccctcttcccccctggctgttgggacccgcatcgcgggaggggaggcaccccccgcgaggcggggactcagagccaacccctcttccccccctggctcttgggaccaccatcgcagggggggaggcaatcctcccgaggcgggactgcaaacctccacctttcctcccctggctctttgcacccccatcgcagggggggaggcacccctcacgacacggggactgagagcgagcccctcttcccccctttgctcttaggatccccatcgctgggggcggaggcaccccccgcgaggcagggactgagaggcaatccctcttccccccctggctcttaggacccccatcgcaggagggggaggcaccccccgcgaggcagggactgagagccagcccctggttcccccactggctcttaggacccccatcgcagaggggggaggcaccccccgcgaggcggggactgcgagccagaccctcttccccctctggcttaggacctccatcgttgatcctaagatccttaggacccacctggaggactgcgggtgttaggtgtccaagtagaaagttcaaatcttccgacggcaggtaccttacgtgggattactgagagccagtccctcttcccccccctggctctgaggacccccatcgcaggagggggaggcaccccccacgagagtggcgactgagagctatcccctcttccgcccctggctgttagtacccccatcgcagggggggaggcaccccccgcgaggcagggactgagagccagtccctcttccccccctggctcttaggacgcccatcacaggagggggacgcaccccccatgaggcagggactgagagccagcccctgttcccccactggctcttaggacccacatcacagagtggggaggcaccccccacgaggcggggactgagagccagaccctcttcccccactggcataggacccccatcgttgatgttaagatccttaggacccacctggaggactgtgggtattaggtgtccaagtagagagttcaaatcttctgacggcaggtaccttatgtgggatttacgatccgacgggtccgaacgcagctcgggaacagaaagaaagcaggttatttgcaatctaccggaaattaagggcagaaggcaggtgagagaattcttaggagctgtggggttttgtagactgtggatcccaaactgcagtattagccaagcctttgtatgaggtcacaaagggggcggggacccggaacttttgaaatggggatcccaacaacagcaagtttttcatgagttacaagaaaatcttctggcagccccagccctggggctacccgatctgacaaagccttttccattgtatgcgtcagagagagaaaagatggcagctggacttttaacccaaactgtggggccctggctgaggccggtagcctacatctctaaacaactagacagggttgctaaaggatggcccccctattagagggccttggcagcaactgccctgctagtacaagaagcaaataagctgattcttgggcaaaacctgaacataaaggccccccattttgtgatggctgagatccatcccctcttcccccctggctcttgggactcccatcacaggggggggaggcacccgctgcgaggcggggactcagagccaacccctcttccccccctggctcttgggaccaccatcgcagggggggaggcaatccccgcgaggcggggactgcgaacctccccctttcctcccctggctctttgcacccccatcgcagggagggaggcacccctcgcgacgcggggactgagagcgagcccctcttcccccctttgctcttaggatccccatcgctgggggcggaggcaccccccgcgaggcagggactgagaggcaatccctcttccccccctggctctgaggacccccatcgcaggagggggaggcaaccctgcgagggtggggactgagagctatcccctcttccgcccctggctgttggtacccccatcgcagggggggggaggcaccccccgcgaggcagggactgacagccagcccctggttcccccactggctcttaggacccccatcgcagaggggggacgcaccccccgcgaggcggggactgagagccagaccctcatcccccaccggcttaggacccacatcgttgatcctaagatccttaggacccacctggaggactgcgggtgttaggtgtccaagtagaaagttcaaatcttctgacggcaggtaccttacgtgggattactgagagccagtccctcttcccccccggctctgaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggaggcaccccccgcgaggcggggactgcgagccagaccctcttcctcccccagcttaggacccccatcgttgatcctaagatccttaggacccacctggaggactgtgggtgttagttgtccaggtagaaatttcaaatcttccgacggcaggtaccttacgtggaattactgagagccagtccctcttccccccctggctctgaggaaccccatcacaggagggggaggcaccccccacgagagtggggactgagagctatcccctcttccgcccctggctgttagtacccccatcgcagggggggaggcaccccccacgagagtggggactgagagctatccccttttccgcccctggctgttagtacccccatcgcagggttggggaggcacccccccgcgaggcagggactgagagccagcccctattcccccactggctcttaggacccccatcgcagaggggggagggaccccccatgaggcggggactgagagccagtccctcttctccctctggctcttaggaaccccattgcaggagggtgtggcaccccccacgagggtggggactgagagctatcccctcttccgcccctggctgttggtacccccatcgcaagggggggaggcacctcccgcgaggcagggactgagagccattccctcttccccccctggctcttaagacccccatcgcaggagggggaggcaccccccgcgagggtggggactgagagctatcccctcttccgcctctggctgatagtacccccatcgcagtgagggaggcaccccccacgaggcagggactgagagccactccctcttccccctctggcgcttaggacccccatcccagcggggggaggcacctcccgtgaggtggggactgagagccagcccctcttcccccccggcttaggacccccgtcgtggatcctcagatccttaggacccacctggaggactgtggatattaggtgtcctagaagaaagttcaaatcttccgacggcaagtgcatgatagtctgcatgaaaccctaataaaaaagacagtgaaggagaatcatgtcaggagctgatactcctgagtctcgggaagcctccagggacagagcacagctagagcatccaagaatgagaagagccctagagcaaacgcaaagcccaggaagagataattggtttgagaagaaaagggtccaggagttattgcaacccagctagcaagcagagtcctgggctgatcagagtggggaaaagccactgagttgttcaatggtaggacaaacagagccctgctgcagggaggggacactcatctaccctgtacccccatacacctctgtcccgctccccgttcaggctgacaatgtgctcaccacacagcagcacctcctggtcttgattgttggggccctcgcaatcattgcactggcccgtcctgccatctgaccagagctcttccctgctacactcttctgtgagtctccagcaggaccttttgcacatcagcaagctgggcagcgtcaagtgcctggaatccaccccatgccttcccacctctggacatttgctcatggttcaattcatggccattgaacttgtcttggtcagttttctttcagctctcagtgatagacacattccacaatgacctacagagaaaaaaaaggctcaaattgtatagcaaaccactacctctactaaagtaacctattgttctttagaactgaagaccagaggctgtgggacttcagtcttatctgggatgtggtgctgacatgatgttcccaaaactctttctatctgtgtccctaactctcagatttacttttctctgtgggtgttaatctcaagcagatagcaaaggtagtttctgctctaagctcatgaagttttacagttcctaacgagagaggaagacagaggcatgctctctcccagggtctacatgtgaaatctcattcagggtttctggttgatccagcactggtcacatggcccagccacttggagtcagttgtgttgtcagagcctgcaccgcaagcgcgttgcacagacaggaacaggactggccagggagggaatctccattaggacaaagtggttctgcagaccttgcagcgtctcctcctcaaatgccttttccttacaagagcttcctctcaaaatgcacccctcctttcaggtcccattctaatgctgtcacctccaaagcagcaacctcatctacctgtctcaactccctaaatgggtgactgttcctgcatctgaatttccatagcattatcatgacacaccatcctcaccattgtcactatcttacctgtaatcatagctgcttgtgatgagcagcagctggaaggacagacatcactgccacttaaaccagctccaacaaggcagagatgaaatagaccggaagaaggggcaaggctgtgagggccctgggagcaagcagggacacctcccatcactctttgagggccctgggagcaagcagggacacctcccatcactctttgagggccctgggagcaagcagggacacctcccatcactggctgccatacagggtgaaaacaatacagcctgagtgcccacattccattccagcattccccccagtaagaacaaaacaggaagggcccaaggaaaacacaaccagcagtgaagtggagctctgtcctctttgctgtcctcactggccgggtgcacaggccaggccctactgaatactactacctaagcagttacaccatggccttagtacccccgcccccgagagcagaaattgtaagcaaattgtccatcaaggtataatggcaaaaggcacaaattaggaccaggccaatggtataaatacacctgcctgtcacccagcccctagagctccttggagaagcctgagtcctgtgttccacggacatcagtggcatagaggccctgagttggactcaggttttcctcagggactgggttttcctcagggaatggggcaagttcctgggggccaaggatgtcttctgactggcctgcatgagggcttcaggaggtgagttgttttatcctcctaagaagccgccttggtatcccactggccttaagcagtcccagaatacccataatttttcctgttggagaccctcacattcttctaagcctcaccttcatacttctgtgactactgaaatatcagccacggctaggttcagatttgtttttttttttttttacttttttttttttaatttgggacagagtctctctctgttacccaggctggagtgcagtgatacaaactcagctcactgtaacctctgcctctcaggttcaagtgattctcctgcctcagcctcctgagtagctgggattacaggcacacaccagcatgcctggctaatttttgtattcttagtagagatggggtttcactatgttggccaggctggtgttgaactcctggcctcaggtgatctgcctgccttggcctcccaaagtgttgggattataggtgtgagtcactgtgcccagcctcagatttttttacaatgatgccacattgcaattaaatggacttgtccctactgaacagagccctctgctgttgtgccctggagccaggttaacacgcatgtgctctatgccacgaagaacacccaccaagctgaggggccctgcaggcattcacatgggaaactgccattgcgaatggagtgagtgaggcagcttaagtggtgggaggggtgcatgggaaggggctcctgagcaggaccttcaagggtgctagagtttggcagagacaagagtaggagcgaagaaagtgagagtctcatgtaaaagggcaaggtcaccttcctgaacagggaagataaatcatagtggatattgtacaataaagattttattcattcatctatgacaaacttttactcgataccaaccatggcctgatgcaaggctgacaccatgggatacagaaatgcttttgagtgtcagtctggggagagacaggcatgtgagcaaataaatgagctgggtctgtcccatgaagagtctagaatagtgcagttggttagcactctctggtgacagaaaggctgtctatctataccatccaatccaatagccacttgccccatatggctgttgagtgcttggaatgaggcctgtgagattgaggaactcaattttaaattttatttaaccttcatctattttaaatttaaatagccagccacatggggctagtggctaccatattgggcagcacagggctggaggcacatggtaagaaatttatatccaataactaataggaagacacattgattagtttttttaaacctatatattaatcgtttcacaagtactagggcttcaatacatggtactgcataaataaagcagtccttgccttcaagtcaaacacatcaccttatcttattgttatctgagaaaatgcaaaggagcccatgggagcgagaggagggacacttcattcagcttcaagggtgtcagggagagttttctgggagattcgatgattaggatgattcttgaagagttaatgggagataaccttgagaaggaggagaaagctatctcaggtggaggcaacaaccccatggttatcagagaagcagcagcatcagggagaggtcagagtattcagggaggtatgtgggcctggagactcgtgcatgtggggcaaagccattcagaatgaccctcggagatgggcagggcaccatggggcttttgcatggggctcaggcctcagatgactttttttaaggtcatggggagtcatttgaaaattggaagcagacacgtgagatttctgtttttctgcttccatttcagtattttccaaaaagcagtaatgttgctggaaagaaggagagcagtgtaagagtttttgtttgttttattggttgcagtgagatctggctctgccacccaggctgcagtgtagtggtatgatcatagctcactgcaacctcgaactcctgggctcaagcgatcttcctgcctcagcctgtcaagtgcatgccaccacacccactcaaggtttttttttgttttttttttgtttgtttgtttgtttgtttttttgataaagattgagtcttcctatgttgcccagcctggtctcaaactcctgggctcaagcagtcctcccacctcggtctcccaaagtactgggattacaggcatgagtcaccgtgcctggcaagagactcgtttgaagttgaatgaaacgaacagaatttggcaatggcttagttgggaaaggagaggttagcagggaaggggcagctgcagcatgtccttaggggtgtcaacatttgtgctgaacacaggccactgtgggaggaggcatcggcttgacacagcaatcctgtggtggaggtgtttgtattttgaggttattattctattgttgattcttggagtaataagaattgagagattacccagaagcaatgggcagtgtaataagaggagagggctggagaacaagctgggtgactcccatgtttacaggcttctggcctcagggaaggcctggaaaaaaggatgggaagaagatgctgttagaatccaggagaaagctacctctaagaaagcaaaaaaggcaggctcatagcagacaagtaacctgaattgggaaagggcccagtggccccggccttggagggcagctggtgtctgcagggagggtggctttggcaggagcacaggtgtggttgaggctgaggtgaccaaagtcggattaacacgaacccgaggcacgtagcacagggggatgagtgtgggggtttcttccgggctgctgcacaggccctcctcttcccagacagcagctgctgagtgtcaggtggggggataaaggccagaagcagagatgccgctaagcccacaaacaggtgcccacgggatcagcctcggcgcccgggcgggtcttaggtctgaaggacacttggagactagatgttaactgttggaaatttagtaaactgggccaccagaggcttaattcactgctttaaagtctgatgattggaaattaacctatgagaattgtcagattacattgaggtttgatctcccgtgcacttacacaaatgcacacagacacagacacagacacaggcatgcacacacctcttttatgagacagataaaaacccagccacaaagatgtcaatgccacacatctaagagcctgtcccataagtaatgcacagggctccagcccccgtgggaggaagataattggactgtaaaatagtgaagggcacggctgggtcaagagagagtcccctaaaaccaaattccagatgatttccatattctgaatggaaagcctgcataatcattatttttaaaacatatcgacttagaaataaaatatagaagtcaaaaaatcaattaagaggactaattcaatgaagagtgttttctggtggctatttttctttttattaaagtttttaatttttttattttttgggcacctagtatatatttatggggtacataagatgttttgatacaagcatgctctagtgactacttttcaagagttaaactgtggactccagagtctgaaaataaagtataatttttgagaatgttcaaattatagttttaaaagtctttggcccattatttatattttttattcttatttggaattaagcacagtattttgttttttcaaaaatttaaacctgactgagagctaggttgtcatggaccattggttatttatcttcttttgatgatacttcatttaataacaaatcagtgttcctgtgtctgatagagttagatgaattaatcaagtcagtgtttattcctccttcaagtggcatcttcttaaaggtagctttgcaaaatgcccaattatttggacaacttaaaaaaagaactatggggccgtgcgcagtggctcacgtccctaatcccagcactttgggaggccgaggcgggcggatcacgaggttaggagatttcaggccatcttggctaacacagtgaaaccccgtctctactaaaaatgcgaaaaattagccgggtgtgatggtgggcgcctgtagtcccagctactcgggaggctgaggcaggagaatggcgtgaacccgggaggcggagtttgcagtgagccgagattgtgccactgcactccagtctgggcaatagagcgagactccgtctcaaaacaaaacacaacagtttctcatatgcaatgatccccacaccgaggtatcaggtaattgtggactgtgccgttcactgtgtactatcaggaatttaggtaaggcagcaaaagagaagaaagtttccctagagctccataccgaggtatcaggtaattgtggactgtgtcgttcactgtgtacagagattggcagggtgtgagtggcagaaagagcttcttaggcagtcagaccacctggctctgaatcctggctcggtcacaaattaattatatggaagaaaaccttaagcctcggtttgattttctcctttaaaaagtgagacaaataaatgcatttatttctcagaagatagttgtgatgcatctattattttatgacatttttgttcatttttaaaaggtcctgacaaattttaagtgttttatgtgatcagttagatgacatgctaataggcaaaaggcttgcctctaatatacatgctgtcaaattttccatcagcttctatatttgcttctctaagatttttttttcctgaatgacataattaattaatgaggtcatgcaaaattcttaaggaaaatagctaagtcagtttccttcattaaaatccactgtaaacaaagacggccctctgtttaatgcttagtttaacagaaaatttaaattagcacagataattcttcacatcatttggttaattgaaggtatgggaaactgtatttgtagtgttcactcaaaccattcccaataagtgaattacccatgggccaaactctggaaattgccagatgaactgtattatataaagatagtatggcatgaatagctgttctttcatattgcctttaatccatcctctttgaaataatagaggcctgagatacatcagtgttattgagcaggaacgcttgaatataaaaccaatcaagacaacatatagtatgaaatagtagcttatcatgtatgtgcatgcatgctattttatttgttttttgctgataaaggtggaatgatgttatgatgaatttcaccatgaaagactgaaatagagcaaacaaaacgtctcaatcagggtttgccagggttattcctaatgagttattcatactggttgtatttttttgaccattgggatttatttatctgagggctgctggaaaaaggagaaagggaagctacgtcatttgccttctgtgtgccaggcattttctctttctttatccctggaataaccttgtgtgggaggtttcattattctcattttacaaatatggaaactagcttagatgaagagagatggagtgaccctccgaaggccttgcagtcagcaagagttcgaagcggggtgagaattcacgtgtttctgatttctaaagccgtattccttccactgccctggttcacatgttagaatgtcacatctttatccttcagacatagtagctcagtctgcatcagactaagatggggaaaaacttgattcctggaaatttccaaacatacggaaaagtggagggaattaggcgataagccagttgtacccatgacccagctgtataattatcaaggcttcggcaatctcgtttcatccatttcactaccactatgatttgaaacaaatgccagatatcatttttctccgctaaaaacattttattatgttggatcctgtttgtgcccgtattttatactaagccttcacataagttatgttctaggatgtcttcaaatgagagtaaaagaggacaccgttgtcttactgctggggaaaagagagggggctttcttctttcttcaacttccctctgtgatacaagggaaaaatgcagctaaattagtctaaaatctcgatcccttgaaaacagaaaaatcaacagttttaagcaaacaaatacaatccccctagtagctaatcattttcatccacgtgcctggtacacatgctaatgttggagggaaaaaaacagggtgatgtgctttttgagtgtggacaccagagggcagagtgtactgattagagtttcctggcattgcaaaagtgcagtgcggcttggggaggaaaagcagtaggctatgaaacattattccttatgtcaatagaaggaaattattacataagggaaaactggcaagatggaagagcttatatccgcttgcagttctgttcattccccctaaactccatatattatttcaggattttcatgagaaaggctcttctttgaagaatcaattgcttatccatggtgttagtttatatgtttgtatcatgataaacatcctatccagaggtgtgaccttccagaccttgctaacagcatgctgctgctttgcaaagctgcctgcgctttgctgctcacctaaaggaggacttctcaataatagacaggatttgattcctttttgtcatgagaaagctccctgattgtgcatttgtaatgcatgaattgcacagatctccctgctgagaggcttacatcacagagttggctcactgtttccagtatcattcttccagcccaacagtaagcactggcagagagcaggtagctgcctaccctgatattacgggacgtcaataggctcttgcacgcaagtgtggtgtttttcattgcacaccaagggttattaggctgtgctgagtcagatggaaataaaaatagcctggaacctgtgcccgtttgtttgggggacttgtcccagcaccatgctaatgagcccaagggcttgggcttgatgtccctggtggttccatcagagcaacatgaaggaaagcaactgtcggaagccacaggccctcacttaatgtggtttgcagagtggtaagtgatggctcttcccacgggtatggttgtctggcacagagagagccgggggacccacacgctcacgcagttcctgccagcaactgtgagacatgacgactgtgacttagcagaatccagggttcatccaccctcctgtgagtcctcctgctccccgttttgctgccatctcgggccaatatctgcaggtgcagagaccctggagtagctgcacctcagcctcatgtcctctgtggtcccttaattgcccaaaagaaagaatttaaatgtaaagtcgctctgtgcagcgagcatgttccttcgtgccctgggcggcctctctgacagccctgactctggtctgtgacgctgggattgtggctgctttcaggcaccgtcatggccttccatggtcctctgtctgcctttgtctccttccttctgtttaggatgccctttagtgggggaactcctggtccgccttcttctctaaatctgtgctctctaccaaggattttccaagcctgcgcttcctcctgtcgtctcctttgctcctctccgtggctctggctcctgttccgcagcccctggacctatatctgtgatcacacttagtgttttatacatcagttattcacttaagtgtcggccgtgcccaccagcccagaagactcaaggacgagtacttttctatacttacctttacacaagatagggtctcagtactcatcgcgattaatacatgaatgaacttcagcaaaataattgcaatgtgtaaaggccaagatccagaataaaacctttcatttcttagctaaaaatctccccacatccattagttttacatccttggcattaaagatcctaaggagaaattggtattcctgtctggaaaaacttgctgttacttaatgtatttgaaagtaagttatttttaaataaatatgaaaccccatctctactaaaaatacaaaaaattagctgggtctagtgatgggtgcctgtaatcccagctactcgggaggctgaggcaggagaattgcttgaacctgggaggaggaggttgcagtgagctgagattgtgccactgcactccagcctgggcaacaagagtgaaactctgtctctaaaatatatatctatgtatgtatgtatgtatgtatgtatgtatgtatgtatgtaagtatctatctatatatctccatatatacatatagagagagatatatagagatctatatagagatagagagatatatatagatatctatatatatctctctatatatgtatatagatatgtagctatatatagagagaaagagacctggagaacatatatactcaacaggtgcatgtcataaccttcggggaaatagggtgggaaggatgaagatgatattttatgtgatctgtactgtgtgagttgtgagtttctgcatatattaattagtaaaataggtaggagcaaatattatgaaagcattaaaacaccaagactaaccaagacaatcatgaagaggaacatttctgtctaactagatggcaacttattataaagtcttagtaattctgatgactataccccacatggatgcagagacagaataagtaaatcagtggaccaaacagaaacaattggtcatatttacacagttcttgttaccagctgggctgttttaaacaactttccaatataaattcatttaatctttgcagctgtccatgaagtaacgtttataggtctccatttaatgctttaagaaaatagaaaaagaaaggttaaattgctgaaagagtcacataagaggaattggcataagagacacaccggctactccctgggtgtgaagctttatagccacagcagggaggggagtgtcaagaaccagggcagggaggataaagaccccgctgagagttccagctcagtttatgattggtatatgcctttcataagcaagtcactattttcttgaaaagaaatggaaatcaagagatgcatgtgttgtcaaagcgggagaaaatatttgcaaactatgtatctgacacagtactactatccagaatgtacaaggaactcaaacaaatcagcaagaaaaaaacaaataatcccatcaaaaagtgggctaaggacatgaatagaaaattttaaaaagaaggtatacaaatggccaacaaacatatgaaaaaatgctcaacctcagtaatgatcagggaaatgcaaattaaaaccacaatgcaataccaccttcctcctgcacaaatggccataattaaaaaatcaaaaaataatagatgttggcatggatatggtgaaaagggagcacttctacactgcttgtaggaatgtaaactagtataaccactatggaaaacagtgtggagattccttaaagaactaaaagtagatctaccatttgatccagccaccccactactgtgtatctatctacccagcagaagataagtcattatatgaaaaagacacttgcacgcacgcctatagcagtacaactcacaattgcaaaaatatggaaccagcctaaatgttcatcaaccaaggagtagagaaagaaaatgtggtatatatacaccatggaatactactcagccataagaaatgaatgaaataatggcattcacagcaacctggacagagttggagaccattattctaagtgaagtaactcaagaatggaaaaccaagtatcgtatgttctcgcttttaagtgggagctcagctatgagggtgcaaaggcataagaatgatataatggactttggggactcggggggaaggctgggagggggatgaaggataaaagattacacatggggtacagtgtatactgcacaggtgatgggtgaaccgacacctcagaaatcaccactaaagaacttacccatgtaaccccaaaccacctgttcctcaaaaactattgaaataaacataaaataaatttttaaaaaagagatacatgtgttgaaatagacaataactctcaactgtaccagaacctacacctccttattttggcaaattattttaatgctcctttcctaatttaaattaaattcataggtgataaaatgtatatgcatataccactttaaaagtttcaatatataggctaaataaaggaatgaacttataatccagttatctgtccttcagcgtgtcactgctcaggtcctgcttgccaggtggtctgcagctagggcactgacatctgtgatgaagtcagaagcttcttcctatgtgtaaagagtaaaactgggtttaaaatatttttttttaaaaaaaaggctgggcgcagtgcctcacacctataatcccagcgctttgggaggccaaggcaggtggatcgcctgaggtcaggagttcaagaccagcctcgccaaaacggtgaacccctgtccctactaaaaatacaaaaattagccatgcacagtggcgggtgcctgtaatcccagctactcgggaggctgaggcaggagaatctcttgaacctgggaggcggaggttgcagtgagccgagattgtggcaatgcactccagcctgggtgacgagggcaaaactccataacaaaaataaataataaatttttaaaaagcagaccagaaatagttccatataaaaaatataggaaaagggaagagcagataatacagaagaaccttagaataaagcctgagattaagtaataatagattagttttattttgaaaatgaaaagaaaatggggacacactccatttgaaatacaggatgcgtaccaaggtggatcacagattgagaggagaaaatgtgtgagattctccactgatagccaggtgtggcttcttctttttaagcatggcgtgaaacaaattatgacatggatgatgagggcatgaagtgtccctgggatcctaccacctgacaaggtgtaccctcagtctccaatgcttaataaatgccttgtaaactgtaacctctgatacttaatgaggaatacagcgctttgaaacagaaaccgaaataggtctctagagaagttgtatgataagatcctgggggcagtgtcagaaaaggaccgaaaaaccacagattcctccctccaggaaataatttcaatacttaaagtttaccatgtagatttcttgttctggtgctataattgtgaagcatataggaaacactataaaatgttttaaaacaatacttttgataaactttattaagacctctatgtttcatgtgtttgcactaaaaataatgtttgcttctaagaatgttcctatttgactaaggtgatttaaaatgcctttgcattgttgcactgtttgtgtagtgattgtaactctgtactaaagccaattaactttgtagttggatgggttataaaatactcactagacacagtactccatagacaccatattcaataatagacacaatgtgtagaatgaagaagccagcgtccacctctgcaacgagcttgtcctgaatccctggaccctttatttttcatcccataaaaactttcagtatcattatgtactgaagtactccttatttatagttctgtggatttattccaacgagtctgttgaaaactgggatgtggggcacctacacttctcaccgtgcaggatctctacccattgcagggtgtccagccccctggcctctaccccaaatgccagtgaagtctaggattcattgtgacaactgaaaaactctcctcatttcaaaaatgcttcctaggaggtagaatggccctgttgagaaccttaaatagattatagattttatttattattattattatttttttttttttgagacagagtctcactctgtcaccaggctagagtgcagtggtgtgatctgagctcactgcaacctccgcctcccgggttcaagcaattctcctgcctcagcctctcgagtagctgagactacaggcacgcatcaccatgcccagctaatttttgtatttttagtagagatggggtttcaccttgttggccaggatggtctcgatctcttgacctcatgatctgccctcctcggcctcccaaagtgtcgggattacaggcatgagctactgctcccggccaatagattatagatataatttttctgttattatttctttcacaaaaccctggctgtacaagtatcctctgtaaacttagatatttccgacagtgtgtctacttccttccttcatgatctcaactctctgtaaattacatgtgaatgcattcaggactgtattttatatatcatctctttcatgttttgatttgctttttccaagcagacattaagtgtgctgaaggtagttgtgttgtcatctgctttcattgaatccttcagaaattttagcaccacaatgagattctgaaaaaagcacagaaaaggggcttaatatagaatgtttaaagaatatttgttttctcaatttatattacgactttcaaacttcagtgcatatgtacacacacacacacacacacacacacacacacacacaccattttaaggcattgctagactcacatatatctttcaccttgaagatgaagcaagattccaaaatgtcagaaaatcttgaaagtgtcttagatacgagcaatatggggagagagccagcaactgagttattcccaagctcatttagtgacaaagttgtgggttggttaggcttgttagagctcaacaaagcacttagtgaaggaaatatgaaaattagaaaccactgtaggatataaattaagactatttggaggctagaaagatttggggattttttttgttgttgttaaaatatctagccaactcctgaaaaataatgagtggttgccatagcaactgtgttttcgcttgacacacgaaagaacatgaaaagcattggaatcaaggaaagccacctggttttagactttaattttggagaaacaaattcatccaaaatgatttataaaacaaaccctattttattttccttccaaaatgattgtagattttttaaatttttttaaattcaaaacattgagggtatctcaaaggaagtgaaaatacattcttttccaaaaaaaaaaaaaaaaaaaaaaaatacctgggccgggtgtggtggctcacgcctgtaatcctagcactttgggaggccgaggtgggtgtatcacgcggtcaggagatggagaccatcctggccaacatggtgaaaccctgtctctactaaaaatacaaaaattagccaggctttgtggtgcatgcccacagtgagctgagatcgcaccactgtactccatcctgggggacagagctagactccatctcaaaaacgaaagtgcctggtcgtctttccacacaactccgtttccactcccataaaatgctacgttagctgttttgagggtagatgcccttagactgccaactcacaaagttttattgggcacctgttacctgttcagcagagatttgtaaaaaaagacacatcaggtggcctttgcttgcaagaaatcagcctttggaacctgtggagaaaagttaagtactgcgtactgcgcaaatgaagggtgggagctattgaagggaagagactcaccccgaaaacccaagaatggtcaaacgagaggcaaggtggagcctgcagttttcactggaaggattctagagtgagtgattctggggacctagagatgggggataacgggtgaaaggaacaagcacggcccctttgaggtggaaaacagactggtgggccagggttgggagggtgtgctggggaagtgttgtgggcagaggctggaaaatgaaattgggctggggttaggagacaggtgaccgtggaagactgctctgacaatcagagtctggactttgctcctctgcaggatccctgatgcccagatggacccttcgatgttcctggcccacctgcgctacctattcttgccccgctctgctctagtatttacaactgcacgatggcacagttggtctctgggacttagaatttgtgttgcaaacacaagacctggagaatggacctggtctgtgatatagtgtgtcagtcagggacctggagaaacagaaggggatcccaaataagaagacttgaaggaagtttaagaaaggcaccaaatacaatttgaaacttgtgggctgggaagccacacgagatagcgcaggctgggggatgtgcaggagctgtcatcagaagccggaagtggaacatgttatgaaaaaggtcacttttcataacactttgcatggagaaggagtacaagggaagtcaagaggacccacagtgggaagtgggctgtgaatactctgatcctacctcatttactgccagtgcatcccttggcctaagtgaagtaggagcttgggagaagattggccgttgactctaatcctgctcccaggttcctacttaatcagcatccaagatcaaggtgtggagttgacagtgacatctcggacttcaatccaccatgttgacttctgattaaccccagtcctgggaatacctccaagaattctactttatttacttctcttatgtaagaatgtttaactcaccatggatcctgcccttagaccaaagcgaccttgatgttattgcacaaattacaggctatgacacatataccattcctgcctgtgctagaggattgcctttaattgcttgctggagcacatatgcttttccctatggtagataagccttgggtctgggagtaagagtgcagagatctacctgtcttggtgccacccaaggtcatacctccgtctgtaagttcccctttcatggaacacaaggtaaacctcacaaagtataaggcagatcttttcccatttcctgcatgtcttctcaatacctgtgattgaaacatgcagtggaaatatccatgcccgtcttgatggatgaagctaactggctggtaggtcgaagccagttcgaggaacaggctaggaggtctgcatggaacctgggattggccatcccctcatgagggctctaatgggaagatgatgccttgggtgtgcctggatgctgagaaaacatgagatgtgtattaccttctgctctctgtatgtaaaacagctgaagctaaatcccttgagatgtttctacatccatctatacctagatcttggaaattttgcaaataagcagttgtcagaattttgagctatggcttagggtattaaaaaatagaaagacaagggaagagggtgttgatggaggcttgagccacttagcatgacctagcccctgatcagctgtggttagtccaaatgagccagtatgctggggcagagagcaggatggagtagcaaaggccctgtagtgaggccctctgtgggggatgagtgtgcttggtagcagtttgaagcattgtgcctctctttcctatgcactgtgatcagtgcacaggaatgtagaaagggccaagcctttcaacaccttagactctgatgcctccagggtggattcactgtgccatggaaaaccacataacatcatcctattagcgtacttttgagagtagatgtgctattaatgatgctaaaacaacagacatacactaccagaatgctcctagcaaaatgaggacatgtagtcaccctttcctctgctccctccccaccacctgtgccattagaagctggaggagggagcggtcactgtggcatggagtaggctgggcaatgaaggcttctaggaaaggcgggccttggttcatgatccgtggtgggattcatgtgggtaggagagaaaatcaagggacgtcaagagcgtggtaatagcttgttactacctggggagaaacatatctgctagagttgccatttagagacatgtcaaaacctccagaaagtgtgtttcaatgccaagtgctaattgtaaaagggaacgtgtctttctgcagttctagtttgttatagaaagggacagctcttgacgttagcaaataaggttgtatgttatggatcctgtggcaactgagtgtatgtgacggaaaatggatgtttactttaaggtcattactgaagactttctggagccacctctttcttggggacgtctccctactgattcatattagaaatcaacttgagtgacctttctcttcaaaacatcagagactgccttggactgtgtggtctgcttggaggacttcaaccctcttagaaccttactctgcatgtgaacacagcagcacaggggcagcgggttccatcgtctacgggagatggtgctcaagggttggagccagtccccctagagagtcacatagcatttggccctcgaccatggctgaataaatgaatgaataaaccttatttaatatatactttcacctgcctgagttgtagaactctgcagaagtccttttatatctcttctacattcatcttcagagccattgtatcataggggttgttttgttattctccatacatcctaatttatagaggagaaaacgaaatccagggaaagctggaaaattgatccagggtcaaacactgaacttatggagaggatggagaggaaagcgtggcttttggagtaatactgctgagagtcaaatcccagttattgcagtgaggagtagcaagaagtcacctaatttcaacaacacaatcatttcaggaatggaaagaacacccccagttccattaaacgacatgaagtacagaaagtcctggctcacagaaggggcccactaagcattagttgccattcctttcttaggtaaccaccgcctgtggaccctcaccccttcctccactgtcagaggcagcataatggctcagtttgcatttcaaggctgatagaatcaagtttgctaatgctggtcctgctgccacctagaactcccttaatgaaagtcagcctccacaaaccttgaggagtattaaaggacagagccctgtgaaggatggtgctgtgtgtgcctatcttttctttttcttttttttttttttttttttgagatggagtctcactctgtcacccaggctggagtgcagtggtgtgatctcagctcactgcaagctctgtcttctgggttcacaccattctcctgcctcagcctcccaagtagctgggactgcaggcgcccgccaccatgcccggctaattttttgtattttttagtagagacggggtttcgctgtgttagccaggatggtctcgatctcctgacctcgtgatccgcccacctcgacctcccaaagtgctgggattacaggcgtgagccaccgtgcctggcctgtgcctatcgtttaactgactagttggattagtgaggagtcggttagttgttgtgcttctttgcagtgcactgggctgctacatggacctgattttgactacctgttctaagggatgaggaagccctccttgcagaagcccatggaagccctccttgcagaagaaatatcccagccactcaggttggcagactctgtgcagaatacccagtgtctttcctcctcttatttatctctcttcaggtaccaggaagtgaaagaggcctatatacatggaagttctgaaggagaatagcgttgccatcctccctacccacctctgagtctctggttcctggtcacccaagcctccatcatgccctcttcccttctcttccttttattttttaataccctaagccacagctcaaaatgctgagcaccacttctcttcagcatgactgaggtctaggtatagatgggtatggggacagctctagggacttagcttcagctgtttcaaataaaggaaaaagcagagaacagggatctcatgttttctcaccagccatgcatgcccaaggcatcttcctatgagagccctgaggagggaacggccaatcccaggttccatgcagtgcctccagcctgttcctgggacaggctccaatctcttggtgcagttagcttcatgcattaagacaggcatggatatttccatgttcttcctgaatcacaggtattgagaggaagtgtgggaaatgggagaacagctgccttatgaatcatgaggttcacctaaaccttgggggctagaattgagatggagcagtgttctgaggggtcccaagaagcctagtataactcataagatgcttgggagtttaaatatgcttttctgtgcagagtctaccatctaagtctctctggtttgaagttggagaaactgaatttgtcattcagctagaaaacatactggaggagagattttaactcatgcctcagaacaaagctcagggctttctgaagcaccagagggtgccaaaggagtcagagcttgggttctgcccattgagaagaatgaagagggatgctggtttcagtttagcaggaggaaaatggtaaaaataacattgaaaagaacaaatagacttacaagggttctcaagatttatctgcaagtgatattttctaaggagactgcgtgtgtcccccaaactccattttcatcatgtcacatttttctcaaaagcatttctataattctagcatgagaagggaagccttggtctaaatgttcatgagcggaaccaagccgcctttccagcctcatcctgcaagcacatactccctggctgcaggtaggtcccctggtagtgtgtagatgccagcatttctgttttaatggtacatggagagaggcgatctaacctaacaacaaattgatgatctagcttgaaaaaaataccaactgccatttctatcaccgtaatttcaaaagcagaaggacattttaacatcaaaaagtgggaaaaacattttcagaacaaatatcatggctccttaattttaaaaagatgccttgggtgcgttggctcacgcctgtaatcccagcactttgggaggccgaggcgggaggatcatgaggtcaggagatcgagaccatcctggctaacatggtgaaaccccatctctactaaaaatacaaaaaaattagccgggcatggtggtgggcgcctggagtcccagctacttgggaggctgaggcaggagaatggtgtgaacccgggaggcagagcttgcagtgagctgagatcgcaccactgcactccagcctgggcgacagagcgagactccgtctcaaaaaaaaaaaaaaaaaaaaaacaggtgcctttataaaaccttgttgtatctctttttcttttgttttaatttaccacaaattcagaagagcttcattatccctagagtaagaaagggaaagaataaagaaaaaaaaagagcttctttaaagaccagcaatccgtggacaggcatttagcagttactgacttagcctacacactgggctgatatagtttctccatctggaatgtccttttatctttcattttatccaattctcaacttcttttccatcccaaagaatatcccatcgccactctcaagcttttccggacattctgcagtaatatctacctcatctgaactgaaaactctcttgcctcttgtactcaattggcctttaccgttcactgtcttctgacatctcttaaatagtgatgagtcattaatgcatctcgccaactagacagtaagcattttatacctctttttaatgtctattattttcagaaaatatgtgatacctaataagtaagtttttaaagtttgctgaacgaacacagtaagttctttgttgtactccttgttttctggaactgtgatgttgtttatgtcgagtcccagaagttaaggcagaagggaattgagaaactgaccctgaaattatgtcataaaaaactgagagttaaaaaagaagccatggctttctattgcaactttaactttcctagtatgcttagtacttattttttatttttatttatttattttttgagatggagtctcatactgtcacccaggctggaatgcaatggcacgatcttggctcactgcaacctctgccttccaggttcaagcggttcttctgcctcagcctcccaagtagctgggataacaggcgctcaccatcatgcctggctaatttttcgtatatttagcaagacagggtttcaccatgttggccaggctcgtcttgaactcctgacctcgtgatctgcctgccttggcctcccaaagtgctgagattacaggcgtgagccaccgcacccagccagcatttatttctaagccaaatcaaaatatagacctttgatgaaggtgttaagaaaacattgcattgtcctggttatttagagatagagacataaattctctatgattatttctcccaaagatcttggaatccaatggatctgagtcaggtcaagatgaatgaatacaaatatgagaagggcatagctcatcagaaattcagagaccctgggtgagcagggttaggcaacttggagaaactttctagacacaggagccatagcactgtaactaaagaaggaggaaaacacagcatgccgagcagggtatagaggctgcaggtgtgtttttccttggctttcatgctgtgctggccctgacacaggactgactttacccataaagaaagtggcagcagcaggaagggcactgtggtgagccctggtgaatccacatggcacttggaccaacccctcagacacaacccctttctcattctgttccatctgctgccctacacgatgttccatttcagggctcgtttctgagcatggaccagttgctaggcacagttctgcagatatacagtgagcagaaacaaccacagagcttactcttttttttttttttttgagatggagtctcgctctgtcacccaggctggagtgcagtggcacaatctcggctcactgcaacctctgcctcccagattcaagcgattctcctgcctcagcctcctgagtagctggcattacaggggcccatcaccacgcccggctaatttttatatttttagtagagacagggtttcaccatgttggccaggatggtctcgaactcctgacctcatgatccacctgccttggcctcctaaagtagagcctacttgtatattgctaagggcccagtgaagaagccagggatctgttaaatatctcacccacacatataacattacacatctgaggactgttgtcaaatgaaatgatgtggttcagggagaccaatgagtgggatgtggctgctgagaatgaggtgcagggtgatgttacatatttttttcccaagaaagggatgtgtaggctgacagctaaagtgtcagtaggtgctcactagtttggaacagaagagaacattgttcatgcaaaggaacagcccgaatgaggctgtgggacaggagggagtgtcacggggctgacagaatgcccacttggctggcacacaaggaagggaaaggagtggtgtgagatgaagctgagcaggtgtcagcaccaacctcttgggactttgcagagtatggcacagattttagcttcattataagagtagcaggaaggcactgaagagtttaaattggcaagtaatgggagctgaactgtgcttttcaaagactactctgtctgctctctacagctgaagaaggactgaatatgggttggagggagagagtgagagcaagcgtagctgggagcaaacatggagtgtaagagcagaggagagaattagccgcaggccagggaccttggaaggacacttctcactaaaagccacactcagctagagagcctttttaacagtgagtgattgttcttctctggtgtttctctctgtccgtccctaatccaagccaggagagaatgaaggctcttagtttaaaaggtcctctggtcctttgctgccccgttcttgcttttctagccagacatggttctctgaggatttgttaaattttatagcccagtggtcaagtaaacatggggtggtactcaaagaaactcacaggtatttattatccaaagctactgcatttggggattattaaatacagacatatagacacatatgtatgcaaggtcattggagtgacatcccatcctgagaacaggggccaccttctacaaatgccaaaaatgcacttcgcacagtgttggaaatttcatcgggtgttcactgaatgcacagacctgctgcagagcctggttcttgtgtctcttgtcttcctgggtgtgctgggatggaggacagattcttatgtccctcattggaatctaccctctcagccagtcttgtgaccacacttttggagtgatggagtgatgggaagcccctcgtggcacagcacctgccccagcaccattggctgaaacggaaacaaccatccacttggcctagcagagtccttgactatcttttagggctttgctctgggaggggctgtgctctctgcctgcctaatatccccacttctggcccagtggggcttgggctgcagtagctgcattccattctggcccatcacgtggcaacaccaaccacgatgcctgccgttttccctgagatgttctgtgccctctcttctgagacactggtggctttctgagaactgctgtatggtgaactccatcttcaagggttattggcttccaaacaccatgacttgcgggagccccgttccctgctcatcagtgtccatgcaattcaggcaactctccccagctatgctagttacttccttcatctaaaccctgtttggaagccctgaagttcctgcctggggaagtcaagtaaaaatgggaggtatgggacttgatagcagcagatgtgcaaaggtcttacaggttacagttgagtctcagtgtgagatgggtcactgggggatgtggcccctgggcagctagtgctatggagtctgtagaatagaggcacagtgatgaccagttatctctggagcactgtgctcagttctaggagacacatttttaagagaaactcgtgctttcctgaggaggtctgggtctgtgctctctgatatacggtagcctctaaccacctgtggatatttaaattttatgtaattaaaattaatgaaaatttaaaacagttgctctggcactggccacatttcagatgaactggagccacatgtggctccggctggagtgtcaggcagcacagtggagagcatgccctgtcctctggaaggatgtggctcagagcacgtccagcccagaagtcacagagccaggacctcatggagtgagaagtagttgaaaacactaaagttgtgtaccctacaaaattgtcctcagacaattcagaatctatgtcacagaagcagaattggatttctcaagagtgactcacaacagcataacttggattaactgaagggatgtaaagagaaggttttagctcaatgcaagtccaacatttccatcagaagtgttcaaaacgtggaatgcgagtctccaggaattgtgatttttttctttcgtttaagacgttcaaatagagactgctgtccaattattgccaatgctagggagggcatttctgcctcagatggaggtagtgaggtgtcagcaaagaatgtggattttagaactaggtagatttaacccaagtcctggttctatcattttctaacttaatggctttgctcaactcaccacacccctccgttctccccagtaaagtgaggacaatactaattgtctcacaatactgtgttgggtgttaaatgagaccacaaagtaaagtatcaaaggcagtgcctgtcccagagcaggtgacttgcactaatcagaggctcaccctgccttgctgctccacacacacgactgactgacaacatccgtgacccacaacatccacagctcattcccacggcagtcctcacgcaggcaccaaaactctaccccactcatgaaatcgacgtgaaatgcaaggaaatcagaatgtggttatctgaggtatcgactttaatcttctctggtttatttttttaaataaattagttacagagcgagactttaatcattatcagtagcagatttcactagcacaattatcaagtgtcaaaaccccaaaggtgagaatcaccgttcttggagcatcctaagccctgtctacctttagaggttccaatgctggcatagggttcaagaccatatgttttattatgaggaattcaagtgagaccagactgttttgttgtaaatactataagaaagacaacatcctttcttctcctccatttctatgcctgtgaagatgtgatgagcaagccttggaagcctcagttcctcagactcttccaggcatggggccatggaacttggcaaaagcgggtgctgtgtggatctcagtctctggagccattcgttgggtcgtgagcagcaaagtagccttcatctttcccagtcttcacacttcgaggaccctcactgctggtggggagggggtttctgctctaggctgtggtaatgctatcccccgacctgcaaattcacacaatgagccaactggccacatgctccaaggagctaagatgctgttggtccacaaacaaaggttcaggttctgtgtagcttaggatccggttgctaattggcttgaaacatttaaatcctcttgcatttagttgaatatgtggatatgcctattgagaagtatgttatgaaatctagggtttgtattcccatccgtaacaggaagaataaaaccttgaaaaatgtttcattttaaatacagaccccttgtgtatcaaaaagtatatttttttgggaatacaaagccaccaccaccaccaccaccattgcccatagaggcgcctgcagaggctggacttgctgcttctggtccgttgagctgagaagcacagaggttcagtgggttgttgagggcaccagggaccccaggtggaactggtaagaaaagctgaatccaatccttggcttttactcaccttgtttaaattactgtccttaagctttttccatattagcctggagccataaatagtttgtgtggctactttcaaaattcaattctgggccgtttgcggtggctcatgcctgtaatcccagcactttgggaggccgaggcgggcggatcacaaagtcaggagatcgagaccatcctggctaacacagtgaaaccccgtctctactaaaaatacaaaaaaattagccaggcgtggtggcgggtgcctgtagtcccagctactcgggaggctgaggcaggagaatggtgtgaacccaggaggtggagcttgcagtgagccgagactgcgccactgcactccagcttgggcaacagagcaagactccttctcaaaaaaaaaaaaaaatcaattctgtgcaattcagtcgtatttattgggaagcctttaggttcccagaagaactgagccaaccttgaagggaacaggaaagaaacagagcctgtgatcagtgggcactcacagcaaataggaatcctccgcctcccctgcttagaaacctccagcaattcctcaggggtgcaggtagaatctcagtccagcagccaagggcttacgtattttgagcggtctatggctttctgttgagcagacttatagcttctcatagctgggcatatttctatttcctgggttatctgaatgcatttcttgtaaccctggcagaagaaaagtttctatcagccctccttgtaggaagaaaatgtgttccctagtttgtaggcagcagagagcctgctgtgttagttgtgtcccgtcagaagcatttgagaaagtctctcgcggtataacaatggcagttttttgcttgagggacagagagagagcagaagctggtgaatctgacaggcaagggtccctaagagaaaggataaggtccctaagaaagggccccctgccctgccttcctcacctcctcttccccccctcaccacgtggcctcaggagatagggcggtgtcactgcctctgctgaccctcccgatgtaccagatgaagagaccgggtcagtaacgcaaggagttgatgtggacatccactgcccagcattttgttcatcgtgcagctttataaactgtccaaagcaaggttcagaagaggcaggattttgcaaaactctcacatcagttccatctaggacgtgtggacatcacagtgattgggatgatgggctggctgacccttggtggttctcaacaatttccaggatgttgcatttatttatccatgacatgacatcaggggtgggagctgtgcttatgcagaaaggggttctcacagactggaccatctgcctacctgctctcccacctgtgtattgtatctgtttatttaggtggaattttaaatttagaaaacagttgcaaaaatactatgacctgtttatatcctttactcagatgaccaattgtttacattttgctccacttactttattattttctctctttctgtatttaccaataaaaagagcattttcttacagaggcacaggaccgtgaccagaatcaggacattcacagttggcacagtatcggcgtctaacctggcatcaacattccagtttcacctgctccctggcacactgtggaccactgccaccttggtctgggatccacccaggcctccagtgtgtgtagttgctctgtctccttaatttcctttcaactagaatatttcttccctctttctttgcctgttatggcctttacatttttcagaacagaacaggttttctgtacagtgcccatcactatgatttgtttgatgtttcctcataattagaattttggccagaatcctagagaagtgatgttttgtccttgccatgcatcctatcaagaggcacgtgatatcagtgtgtcctgctggcgatggtcattttgatctcttgtttaaggtggcatctgtaaggttttcccaccgtaggttgctctatttcctttgaaatgaacaagtaattgtggggcgattttttcggactatattcatatcttttgactcatcaaattttcacctcctagtttgggcatgcattgatgattcttacccgagtcaagtattattacaatggttgtcagatggcaatcttctaatttcatttctccgtctgcgcccatcagttggcattctacaaaaatatggagccgtcgtgagcttgcgtctccttgtgcaagagctgtggctatgctgagcttctccacatatttccaactttagtacatgggcaggtgaggcaagcaccactcttaccttcgaacaccacacacacacaccacacacacatatcacataatacacaccccacataccactcacacagcataacacaccacataacacacatcctacatatgacatcatacatcatacacaccacacacacaccaaatacaccacatgccacacaacttacataccacatcatacacatcatacacacgacacacagcacataacacaccacatgccatacatcctacatacatcatacacaccatacacacacatcaaataccacaccacatgccacacaacctacacaccacatcatacacagcatacacatgcatgacacatagcacataacacaccacatgccacacaacctacataccacatcctacacaccacacacaccccataacataccacatcacataccacacacaccatataccacatcatatacaccacacacaaaccacacacacaaatgcaaacaccacatacaccatacatacccacacacacaaacactgtataccatacaccacactgtacacaccacaaacacacacacaccataccccacacacacaccatacacacacacacacacacaccatacacacacacacacacacacataaaaaaaaacttctgttgaggctgtgcccccaccacttggagccactacatctccctacctcaacttctttccacttggtagtcctgtcttctgaagttagtaaatgcaggcgtgaggcagggaggcgctttggctgattggcggaaccctgggatgagccacagcatggctgtgtggcacgtgtggtgtgggtgtgggtagggggatcccgccgtgcttccttcccaccctgagtcccgtgtgtgccccttacagtgtgtttcctattaaagttcctttcatgtttgggccaagggtgtttcctttaattcctgctagcataaaagaatgaggttttctgcagcaatttctaagtctgaaaagggaggctctggggtaaaaatgttgaacaattaaaatgattagaaattatctatataaaatacaggtatacaaaatatgtatattgaatcctagctagacagacggtatccccgggagaactcctccttgaggaatgggccatttgcttcataatagatgcgagatcatcctcgggccagttagcatgcacagtttcccgggatgctttgcgatacaaattcataaacattgattgaaaggtcaggggacgttcccatcaacacgcggctctgtcggattgttcaagggaaagttagcactgttgcatgcaggcagttgagttcttagggaagagtgctggccctggtggagttttccatgtctgtgtgatttggtgtggtgtgatatagtcaatgggacttggttcggcgcagggagagctgcatgtttctgctcatgttatctggaaataaggattcgggctctgtgtgctgaattatgtttgcggcgatctcacagttgtgaagaagaggcatggctgggaggcatgttcagagctggagagggtataaaattctcatttcttaccttctctgagggaaggagtgtggagtggcagatttccagtctctgggtcttatatcagtgtcgttctctgggaccagcactgtccccatatgggtaccactgggacgtgtagttgacctctgacgtgcacggcagatgcacggacaggcagggtggtgctgggtgagcattagccgtgtgcagctggtgagcctatgccttcttgttggcaggcctcgctgctgagagtaagttggtgaggacccatgcacgtaggttctcacatgtttccaaaggtcccttcctgcctcactggtgagcctttctcccaaatgagaactcctcgctcttgcctccctttctactttctacatcttcctgggacttcctggccatctcctttctgcatgcatgctgcaggaatttccactccagggagggagctctcagtatctgcacagcccaggtgcaggacatgtgctgcccaggctgggttgctgtctgttgtttcaccctgcacagtgaagagaatggggggttaatgtgtcaggcatggcatgcgtgatttagaaccattcatgcctccaagtatttgaggcagctcctgggatccacatctgtgagcaaggaaactgaggcctggcttaaatcacacgtccaagaccagagttaggaacagggcacctgcctggacccaggttcacacctgtaagcatgtcgtgggtgtgggatatgccttagctctctgagcacgtggcagaaatttggggatctatcacccactaccgtaactgtgacaacgtctccacaggaggagcggcaaagtctaaattaaaagaacgtttcccgcagggggcgctcttttttggatctctctgcttggagatatctctgcctgtgtaggatcaaagcagagggaacctctgtgttttcaaataatgtttttcccctaaagcagcaccagtcctaattgagtaatagagtaacaagaagtagaaaggggaagctttagcagctgggccttcacctggtcttccaacaagccccaactcgacgagagccaaagcaagagacaccatttggaggggaagataagaagtcttcacaaggtcttttccggtgttctgctttttcctgggaggcggccttggcgtgtccctgagacctcctgtgatgctcacggctctggcgctgccatttttcttgggtgtcgtctggtggtgtctgcaaggccagctataatgtcagggctgtgctcgatagcacagaaaagacagcgtcctggaggagagcttgttggagcagatttacaagggagggtgtgggtgtcactcacagttcacgctacaggacaatccctttcactctgggagctgagtcccaggtgagagctaagttccaggcgagaccagggagtcgaggggactggatttctgcttctctcccaggagctgcgggctgggaaggggaaggaacagagctgaggtgtgacatcgcccccggtttcccctgttgcccaggttatagcttgggtggggctgacttcagaggcaacattagaaccttttaaaatacccttaatgatttacatgaattagaacaagaaggcagctgggtgtcgtggaaagcgagtgggatctgggttatgtcctcactgtgcctttttatgcacacaaagatttatctacccatgctatcaacttagtgtgtattatagtgaaatgccgtaaataatctcatgtcccctttatacagataagaaaaatttttcagggacattgagttaacttgataaagttctccagttatcaacctggtaattccagttctagaaaatggcaagaggtaaatgccaacagtgggtatttatataagaatgattatggatcagttaagcaagtcagtaaaaggaaatcgctagtgtgcataaggtgctattgaggcaatacctttatgcttttggtttataaagtaaaacattttaaatcttggtatttgtgctatgtctgcataataaaatatttcataattaaagtcatactttggaagattttttattatataagaaaatctctatattacaacattaagtgaaaacagtgggagaataaaatctaaaactacatatagagaccaaatcttataaacaatagattaaaaatactagtaaaaatagtataatgactatactagatttgctgtctctgtgtgtgaaattatgattaaatgatttctagtttatcctttctatattattccagatgtttcactattaacatcaattatatttataacaacagcagcaaaggtcaacgtgatttatatttttagaaaaccaggtattagtagttatggttatgtagcaaggctggctcaagaaatggatcagactctgagaggaaagacccacggttttgttgggtattcaccgtgtgctccccttgtaggtagaggtgatgggatggacctggcgttcactgcagctgcctgtctccacactgcacagcctgctttggaggacgcccagcctccccttgctggcctcctagcagtctcgtcagtttttcctgcaatgtgagtcactccctttgctgtagcctgggtgtacctggaaccagccaattgcatatccacagtcaggcggccactcagtctcctaccagagtttacaaagccagggtcctacaaacaccctcataagtgggcttattttggcccatcccatgaaagaagaggctgagtctgacaacagcaggagcagcagcaatgatcgcttattccgaggcctctatgtgcagggcacacctccactctcccgccgtgctgcgagccctttgagggcaggacccgtctgattcaacgctattgctccagcatagctggacagggcttcacactggacatgctcagtaaacttgagaacgtaaaacagatgatcgaattcctctgtactccagatgattttgctaaacagaattattacatatttaaaatacaggattatcactatttgaagatgaaattagacacttatataataaattaccccaacacttagtggcttaaaactatgcacatttgttacccacagggtctgggtagcagggatctgggagcagactggctggtactctggctcaggccttccaggagcacgcagctagtgctggctgaggcagctgtcacctgagggcttgtggaggcagcagggcaacgtccaggctctcttatgtggcctctggcaggaggcctcgggtgctagccacgtaggcccttcctcatgatgtggcatttggattctcccagaacaagtgactgagggagtggtgggagggaggttggtggagacagcagcgtagccccttcctgtgatctagtcttatgggttgtgctcgctcacttctgccatatacattaggagcaattcataaaatccagcccagacacaagactccacctcttgaagggagaggtattgatatggttctgctgtgtccccacccaaatctcaccttgaattgtagctcccataatcctgttggattatgttggaggagggaccctgtgggaggtaatttaatcgtggagatggttaccctcatgctttctcatgatagtgagttctcacgagatctgatggttttataaggggcttttccccttttgctcagcacttctccttcctgctgccgtgtgaagaaggacatatttccttccccttctgccatgattgtaagtttcctgaggcctccccagccatgctgaactgtgagtcaattaaacctcttttctttataaattacccagtattaggtatgtctttattagctgtgtgagaatggactaatacaggtatcaaagaatttgcggtcatcttttttaaaatcacaaaatttcaggagatttaattaataaagtgagactcaggtctaggcaggtaattagaggggcctccaagaaggaaacaaagactttgtctaacacactatggtctggagacagatctcctaggggccttgctcagctttttgcttacagcattgagctccagggattggctctgcttgccacagggtgatgtgccccatctctttatgttactgagggcagaagaagggtggatatctatagtttgcctgcatttcaggatccaagtcaagaaggagaagaaagaggaatggccctattgtgggagcctccatgatcgctactgcatttggcagtgatatatactcccttaacctttcctctgcaaagaaattgataatgatacttgcactagtaaatgtccacttctaaatgtctgtataaataaaacaagtatctaaactcattcttgccccataaaatgtctacactttaaaagtaaatcatgccaatctgctcatacaggcagaaactaaagagcctttaaatttgttttgcaaacaatcacatcaggatttgttctaatatactgatgcagtggacagatttatgatttttaggaagataggcacatattttgcagagagtaaaaatggaaattcagtgatagaaaatggaggtttgctccatgtaaggataggggctcatatgactcagtggaaaatagaggataatcgactctattatcctgcctttatgtggaattgcaataatgtccattcatattaaaaataaaattgaagactttcctaataatccagtcattcacaaataaatattgattgaatgccaaatatattccaggcaccagacactctcttaagcacttggatacagcagtgagcaacaaaaaaccttgccttccttggctttgaattccaatgcatagggaacaaaagcaaatgaatcagtaaaaattattacatgttatatggtgataaattataaaggaaaaaaatcagggaatgaatatagagggtcagggaaatggcttaaaattattaaaagcgtggccaagaggtcacgttgcaaagttcacatttgcccaaatagctaaatgaagcaagggagtgaaccaccacagccagctggaggaagagcattttgagaatacagaataagtgcaaaggccctggggtggtcggggagggtggtctgtgcaagagcatgacgaagtccatcgtggctgaggagtggtcagaagaacctgaccatgtgtgcctgttggttatttaaggattttggttttaaccaaagtgagctgggtggctgctggagggtgtgaaggaagagactcctaatctgagatggatctctgggatgaatggttgttggtgtttgagaagctattgcagtaatcgagtcaagaaatggtgctggcgtggccccgggtggcagtggtgggtgaaagcactgagagtgtgttctgcgaggagacttgccaagattgacccacagaccacatgtgggatattagggagcataacagtcaggtttctggcccagcccctgcaagtatagagtgccattgtttttagattgggaatgctgagaaaggaacaggtttagggttatgtttggtttgtaaagtttaagatgccattggatactgaaataaatgtatgaatctggagttcacagaaaaggtttcgattagattataatagagcaaaatcaacttccagagtagaagtgggagttttattttttatttatttattttattttttaccagaactgctatttttacaaactgaaagtcccttagaacatacactgaaaaaaaaatcccagttattctctgagtccttacatagaattgaagaccacctgcctgtttgtctttgcctgtttccttttcttctgttcttaactcctctccagctcctgaatagcaattttgtttctctctgcctcatgcaacagacttttctggatgattcgccccatcccccgtcatgccaagcctctgccccacttcatttctctttcagtgagtggagcctccgccgtctcccagacctattgttgcctggaccctctcaagcctaccccttcctctcctccctcccctcctttactccgtccctttccatggagccacactcggggcaagaccatctgctctggccttccgaggcttccgcactgctggcagatgctccccacgtcccctagaatggtttgtgatctttctctgtctggtcccaacatgcctttccagcctcctccctccccacgccagcagttaacccacgcatccatccaggagatttcccacacagactgcacataccgcacaggtgtgacctgctggtgatgatctgctttctctaaaatggactttcccttctgtctgcacttgctgatcaacaaaaagcctgctgggcctttaagacaggcctcaaaccacctctgctgtgaagcctgcccttcctcgtcaagaccccaaacgaggctcacctccccgtgaccgtgcagcgtgctgctggtcctgccaacggtgcccctgacggagctgtggttggtcctgtgtttacctcttcggcctttccacccctccagaggtccgcctcttgtctccaggtctttgtatctaactgaccagttggacactcaccaacctgaatgccatgtggtgttctggaaagcttcctctgtaatttccagttcagatcagttgttcatcctgtgcactccagtctcatcctgtgcttaattctaccacaacaaacaacgcagtattaaaattgtctgtgcagctttctctgcagtctgaaagacctcgaagagaacagacctgccttatttactgtgcgagtatccagctagagcctggagctcagtaaatatctgtgatttcactctttctctttctccttccatcccttcccctgtcctcctctccctttcttctttctttccttctttctttcagcacacatcagtacaattccacacaatggaaagagaagagtgaacaaggcaggacatttagaagggaaagtggaggagcaaagtgaggaaatcttatcagaaaaggggtgatcagcaatgtttaatgttgtcacaggcaagaaatatgcaggcaaaaaaatcctttacattctgtaactaggatgttgcatggagatttatataaagagtgttgggctgggcacagtggctcatgcctgtaatcccagccctctgggaggctgaggcgggcggatcacctgaggtcaggagttgtagacaagcctggtcaacatggtgaaaccccatctctaccaaaaatacaaaaattagctgggcactgtggcgggcgcatgtaatcccagcttctcgggaggctgaggtgagagaatcacttgaacctgggaggcagaggtttcagtgagccgagatggcgccattgcactccagcctgggcaacaagagcaaaactccatactccatctcaaaaaaaaaaaaaaaaaaaaaaaagaatgttaacacttcttgctcctaccgtcttactcatttcttccttcgtcactcattcattcagtaaacattggatttctatttcctgcctcctctaagattttctaggcacttggacctcaaagatgaagctattctcacacgcacagattgtcaggactttgaggctttatgggtgatgggcctttacacattgtactgtctccataaagcccctccttagcttccatttttttttcttttgagacagagttccactcttgttgcccaggctggagtgcaatgaatggcacagtctcggctcactgcaacctttgcctcctgggttcaagcgattctcccgcctcagcctcctgagtagctgggattacaggcacacaccaatacgcccagctaatttttgtatttttgtagacatggggtttcaccatgttggccaggctggtctcagactcctgacctcaggtaatccgcccgcctcagcctcccaaagtgctgggattacaggcatgagccactgtgcccagccaagcccctttttagtttctgtggggacccctcattcagccacagacttgccccttcaatggccacttcattcttccatgtgcgtttttccttgttctcaagttgtctcctcagcttgagtgtgaaaaacatttcatgctttttagtatcatccttaggataagtctcatatctgtgcactttcatattgatcaaaaaaatcacaagaggataactgaatggacaactataaaacctcctgtttctctatttcatgtcagacaaccctagctcccttagctttgcttccagctcctttttcctgatgctttaatcattgctgttcctctcttaatgtgcatcatgcacactatagttctctaaaatcaggccactttaagccatccacaggattttatggaatactaatcagtgtcatgttccactcaacatgtgatcggattttgagagcagtgaacagggtgtcctctgagggcctggggtaatacccccattctgaatcacaaaggccagccccatggggtcagagggttggcctggttagccttgtggagcctgtgttctccaaacagacatttaattactgtccccaatgagtaccctgatcacaatacttattgctccaatggggtctgtgggtggggattgcaaaggggaaggttgccctgcttagctcaaggggagcatctcctgagaaagctgattccgacagaagtgcagtcaactcagcaagcctcttccttctgtcctgttcctaaaaccatctgctcattgcaggaagcgactccattccgtcagccatactgatggcattaggttctcctaaaacatctgggttttccttgtgggagaaaatcctgcagtgaatttagatgttggtggacctctaagcaagggcctcattgagtataggaggggaaattataaatgtcaaattataagtgtgcaaattatacaagtgcacccctgcttggccttgcagggcaccactggccagctcccccctctccaatttttcttctgttgccgtgatggtgaatgttagttgtcaacttgattggattgaaggatgcctagatagctggtaatgtgtgatttctgggtgtgtcggtgagggtgctgccagaggagactgacgtttgagtcagtggactgggagaggaagacccatcctcagtgtgggtgggcaccatcccatcggctgccagtgcaggcagaacaaagcaggcagaagaaggtaagataagcttactcgctggttcttctggcttcttgctttatcctgtgctggatgcttctttcagcttctcctgcccttggacatcagactcccggttcctccgcctttggactctggcacttatgctagtggtttgccgggggctctccagcctctggccacagtctgaaggctgcattgtcggcttccctggttttgaggcttttggacttggactgagccactaccggcttctctcttccccagcttgcagatggcctatggtgggacttcacgtcgtgagcatgtgagacaattctccctaataagctccgtttcatatacacatacatcccacagatctgtccctctggagattcctgaccaatacggttgcccacccttctttgtctcttctttgccacgttcacttctacgtggcctcacggaacccacgtggccttgcctttctggaatcgcagtctcctccatgtggagatgcgtcacctgtagctgatggataatcacttggaaatgcagctgccccggacgggaaggggttgtgcatttctcatattgtttttggctagaccttgagaaattttgcttcctggacaacttagtcatattttatgaagatcctttgtcagtggctagaaaattggacatgtatgatatatggctggggaggactaatgggctcttccttcaacactctgtcaaagtggggccagtgcccatggtggaacgtgctttagtaagatgagagaaggtgttttcatgattaacaaggcatggcattcgtatttcaaagatcacatgacatatcaaaacagtctgctaccgtgtatttatttggtggcatggacatgggacatgtggtattttctcagggacccttcggccctggacctgtgctgtgcaggcatctgcctgtacacactgcagctgttaacctgtgcataacaaacagccaatgtaagatcagatttgaggctgggagtggtggcacacctctgtgtgtgtgcttacataacatacactcaatgtaagatcagatttgaggctgggagtggtggcacacctctatgtgtgtgcttacgtaacaaacactcagtgtaagatcaggtttgaggctgggagtcgtggcatacctctgtgtgtgtgcctacataacaaacactcagtgtaagattaggtttgaggctgggagtggtggcacacctctgtgtgtgtgcttacataacaaacactcagtgtaagatcaggtttgaggctgggagtggtggcacacgcctgcggtcccagctactccagaggctgaggtgggaggacgcttaagctcaggaggtcaaggctgcactgagccatgatttcaccactgcactccagcctgggtgatagagtgagactctgtctaaaaaacaaaaccaaaaaaacataagatcgaatttgactcgaccgtttgtccctctgacacgtaatctaagatgtcagaagtatttgtgtcaaagaaggcaagtgggagagaccgggcctgaggtgatgctgtgttccttctttgatgacatcattaacgaggagagggatggccaaaagaatccaaaatgaaaagtgtgctgataacagaaccaatcacaggcacaactagcctgggattccaggcctgccgaggctgctcactgcggagcctgtgtctgattctgtgtgaccagagccttggctgcaaataacgaccagcctttcctcatcacccaccagcaggcacccaccacagccctgtttgaggtcctttgaactcacagttttagaaaaggtcagtagtcaggtgatatggtttagctgtgtgcccacccaaatctcatctgaattgtagctcccataattcccaagtgtcctgggagggacacagtgggaggtaatcgattcatgagggtgggtctttcctgtgctgttctcatgagaatgaatagggcttacaagagctgatggtttataaaggggagttcccctgcacttgctgtctttgtctgctgccgtggaagacgtgcctttacttctcctttgccttctgccgtgattgtgaggcctccccagccatgtggaactgtgagtccattaaacctctttcctttataaattacccagtcttgggtatgtctttattagcagcatgagaacagactgatgcatcaggataagtccacattgcaggctcttcagggcatggccccgactcgctttcccatctcacttttggcctgtccctcatgtgtaccctgggcccagctgtgacctatggaacggtataactcccctgaatacactgtgctcccacagattatgtgcctgcccactccatctccacagcccccatggagaggagagaaaggggtggcagactctgcctatgcgcccttgtttcttactcagagataaaagttcattcagaaaacatcttgagttcccccaggctccgttacttccttctttgctcccatagcattacctggtgaaaagtgcttctgttgcaaaacttatgttcatgtgtctgcctcacttctccatgaggggctcagtttcttaagaggaggaacagaaaggctaggtctggtctctgcatctccaaccgctaggccaggcgttatatccttggtgcgtgtttatagaatgtgatggtagacatggagtgtggtggggtgagcagagcagatgtgattgacattctggtgaaaaggctgagcaaacacaggacccactgctctgtccctgcactgggctgcgtgctggagattcagtggccactcatgctgctgctgtgttcttgtggaggtaagaggcagtgggtagaggagcaacaggtgatatgtgaatgctcctgactttgtaggaaatgggaaaggggctgatgggtgggggtgcacgtgggtgaaggaggtctgggaaggtgtctctcctgagaaggcagcagctggtctgggaatgaagggtgcgatggagctcactgacaacccaggcacaggtgagagcaggtgcacagtccctggagagaaaagaggctgaaaggctggaggaaaagttgagacccatgtggggagggacggatgaaggttcagatcaggggcctccggaagtgagggaaggagcaacgcactgacgctgagtgctttcaagcaggggagtgcagagaatggatttcaccttgaaaagtgaatgtggaccataacaagtgttggcgaggatatggagagaagggaaccctcacacagtgttagagggaatgtgagttttacagccatatggaaaatagtgtggaggttccttaaaaaaaaaatccaaaatagaattactggatgatccagcaatcccacttctgggtttagaaccaaaggaactgaaatcagcttgtcaaagagacatctgcactcccatgctcactgcagcactgttctggatggccaggatatggaaacattccctgtgctcatccacagatgaatggataagaaacgtgtggtgtatgtacacaatggaatactatgcagccttaaaaaagcaggagagtctgtcaattgtgacaacatgaatgaacctggaggacattgtgttaaatgaaataagccaggcacagaaagacaaataccacattatgtcacttgtgtagaatcttaaaaagtcaaaattacagaggcagagactagctcagggatggttgggggtgggttggggagatgttggtacaaggatataaaatttcattggacaggaggcataagtttttgagatcaattgcacaacatggtgactatatttaataatgtaaagtatgtttcagaaattgctgagagtagattttaaatatttgtaccacacacccacaaacataagtctgtgaggtgatatatatgttaactagcttgatataagcattccatatgtgtatatgtatatcaaaacatcataatggaccccatgaatatatgtaattattatttgtcagttttaaacattttttttaaatgaacatggaggttggggaaccttaccagggttcttttggtctccgccttgcctggggcccagaagtgctggtgaggggttgctccctactctggagctctggatgctgatcagagaccctccatgcctggtgacatctcagactcagtgaacagcctcaggggcccttcacaaaactgggctgtcagggccacctggagctcagagtggtaatttggttccatttgaacttcaattttcgttgctttgaaatctcattcagttgaatttaataacaaataaataattcatggggactggacaatgaaaggaaaatttaaaaatgtgttcacccaaatatataaaggggcaccttgtccctcagccctgttctctaccttcttttctcagctggcttctgggcagattcatggcgccaaaggatgatgcgttaactctctcagggtgctgagggttctctcatcatgagacttctgtgggttagggactgggcaagaggtgagcaagtatcccacctctggcaggccagcctctcagccaccaatttgctaagtggcccaccggtcatctctgagccttgtttccttgcttgtaaaatgcagaaatctttagtaaaccaattgatgtaggcaaatgtcatgaatggatacacagtcatctcagggaatttacatggtgttaaagtatcactccagggatcatctgctggttgcaaggggagaaatgtgactttatcctggagaacaccgatgctctccaccttatcaattcctgcatccctaacactgggacaagcagatatccttccatgccccatgcggtgcctagcatcacctgtgaggtaatgccacaaacttgtgagctgaacttaatcaagctcttaggtctaactttcagtgcgtaacaaacacaggctgcagagcatccagctaatgcacaccaggaggaaacagccagacaaatccagaaggtggaaacgtggaggcaacaactcacccattccttccagcaagccagcaatgtgtggtgggctggggagccactggggcggacaggttctaagttgaaatatacgttaccaccaaccaagggcaattcctgggcctcggctaaatccttacctatacaaaccagctataccagtcactttagagtaattggggaagttattacatgagattagaaaattgtattcattttttaagtgtgaaaatgttctttttcctttttaaaaaagcttctgttttaggttcagtggcacatatgcaggtttgttacatagagaagcttatgtcatgggggtttgttgaacagactcttcttaattatacaggaaaacgtctagagcttgtggtctctcttctttagcgttgcttactgagattttttaaaaagatgcatcctgaatgatttcgaggcataatgttttggtacctgtatgcaattgaaataatttttaaaatagatatggagtaaatatgaaaactaacaattttcaaaattttaatgaggagcatatgaaaattatactctagtatgctgttacttttcttttctttttttcttttttcttttttcttttttgagacagtcttgctctgttgcccaggctggactgctgtggcacaatctcagttcattgcaacctctgcctcccaggttcaagtgattttcctgtctcagcctcctgagtagctgggattatggggcacccaccaccatgcccagctaatttttgtatttttagtagagatagggtttcaccatgttggccaggctggtctggaactcctgacctcaagtgatccacccgcctcagcctcccaaaatgctgggattacaggcgtgagccaccgcgcctggccgctgttaattttctaatctttaaaaataataatagtttttttaaaaagctgctcacaaatattttattgatgatgtgtgcatttttttttcctctggtaggacataattctccctgagaaggggaaagacagtaagaattttgtgagttgcataatagtccattgattaccctttgtcccccagtggagggcactaaacccctgaagaagcaggcccctgtgtgggcgtgttatgattgtagaacaaggagaggggaccctccagtactcagtgtctttagtgggtggggcgggggcttcaaggcagtagcctcagatacctgcggggcccatgcagggaaccctaattggggtgcagggtgggggagcaacagaatgcaaaatagctcttagtaccttacctaaatattggttgctagattttttcattgactggaagctttcatttggctctggatagaagtgtgggcagtcacacaagtcaaggtaagaggggtggaaactggtttttgctggtgcttcctaacatttgtcaactgtggctttcaggctaccaatgggtggggagttttgtgcgagaaaatggaccacatttgcatcctggtgttctccaaatgatgttaaatgcagaaacattcaatgcaatgagtttgttcaattccatccaactaaaaattgtgtttgtgctattagtgcctaccctctgatcagtcttgtactaggtaggaaacatggtgcttaccctttactaaggagttgtgttacatgaaacagaaaacactatgactgaatcaaaaagaagcatcactctgcttgggtagtcagggaagaatcttgatttcccctggaatctggtacttacctcgcggtgaatatacaataacagccagagttttaaaatagacaagaaggacagaaatcagagagaaaaacacagacacatcagaccccttatcataaggtacaaacaatagagcagaagggagaccacaaacttccattctttatgggatgagcgagaaaggggatggaggctttggcaatgttgaatgggttttccacaggaacagccagccccaactgatgtgtagtgatttcctaggaagtttgcaaacctcatcccaccaagaggaaatgggtcgggagttctccatcatctggaggtcacagagcagacagaccatggcccaggacaagatctagaagttgttattttattcaaagtcagaaaaccttccagggtctggggatcagtgtctggatagaagagaaaatacaagagaaagcaagaggttaatgtgggctgaaggcttagaatgagcagttttaggataaaggatagttaggaaaggatgggggatggagaggagggtgcatgtaaggcaggacaaaccaaagagaaagacctgaatgtatctgctgtgtctgtgggacatagggaggttctgttcattctgaatgggggcttcgagctcaagcctaaaaatccatcctttcaaataggtacagaaagaagggctttgacaagtaccatgggctgtgcttgattgaaaggacagacacattcagttgttgttatttgtgattattgtcagctccatcattgatggcactgtgcattttttgaagtaggtctctcccatcaaactgccaggattccagtgatcagagagcaggtcttcagtagcacaggctggattgggtggtgcccactcccggcttgaccacttagctctgtggtgccttggtatcctcatctgtaacgtggggataataatggtgtctgtctcataagaatgttttgagaaacaaatgagaaaacccaagtcaagctcttctagaagtgcatggcagatagtaaacagtcaatcaacattatcagtcctatcaccggtgtgggtactgttgagatacctgtgagagtaaatcatgatttatgccaatggttaatggaaaatatttattttagttattttcttatctgggtagtgccagatgggataataaaaatgaaaacaggcagggtttcgtgtgtgtgtgtgtgtgtgtgtgtgtgtgtgtgtgtgttgctttgtttgcaagcatgatttagttgaaattagatgtctcttctgatctataatctctttgtcttcagactgaaacctgaaatcccatctgaatatggctgaagcaaatctgcacacagtgtcttgatgggaggatatgactaactcttagattggaattgtgttggtgcgtaggcaggttctattattaggggtaatgttaccacattattaaaatatttttaggcataagacaggattctttccttcacagataaatggtgaaacacacatattcctaatttttaaattttgatcaaaattttattaaggccaaaatgggcagagactgggtaacagaagccatattttccaatttgccctcctttactctcccagattctccttgcatgttggctggagtggatcacgaagggtaggaagctgagaaaggtggaataattggaatgttctgcaactctgaagccaaacaaacttaggttttggatgacgtggacagtggatatcatatcacctgttatggtgaaaccatcaccaatacttactttacaattcccatcacacaccccagtgactttctgtgaaagagagatcagatatctactgtatttagatcaactattacattatcaacagtggaggaataaggaaatctaggatgctgtttagtagcaaggaatgcatcaacaatagataaaaggtggccaggcatggtggctcacacctttaatcccagtattttgggaggctgaggcgggtggatcatttgaggccagaagttcgagaccagcctggccaacatggtgaaaccctgtctctactaaaaatacaaatattagccaggcgtggtggcacatgcctgtaaccccagctcctcaggaggctgagggaggagacttgcttgaatccaggaggcagaggttgcagtgaactgagattatgctgctgcactcctgcttgggcaacagagtgagactccatctcaaaaaaagaaaaaaaaaaggaatctctcagtaggtactaaataaaacagggaaaaaaacataactaaacataactacaaactttcttttctttcttttttttgtgataagaacacttaacatgagatctaccctctccataaatgtttaagtcttgttaactgaaagcacaataggatacagcaaatatctagaacttatttcattttgcacaactgaaactttgtacccatggaacgcctcccatttccccttctcccaagcccctggcaagcacctctctactctctgtacaagtctgcctgctttaggaagtggaaccatgtagggtttatccttctgtggttggttcatttcacttaccataacatcctgtaggttcagtcatgtttttgcatatggcaggattttctgctgtattaaggctaaataatacttgatggtatatatgtgccacattttctttatccattcgtctgtcaatgagcatttagatggtttccacatttgggctattatgaataatgctgcaatgaacatggaagtgcagatagttctttgaggtcctgattttaattattttggatacgtacctggaaatgagattgttggattatatggtggttctatttttagtgttttcaggaagcctcatactgtattccaaagtggctataccattttgcattccccccaacaatgtacaaggattctgatttctacacatccttgtcaacatttgttttcctacatatatatatatatatatacacacacacacacacacatacacacaacacacacacctacatacatatagatatataatagcaaccctcataggtgtgaggtgatacctctttgtggttttgatttcatttccctgatggttaatgatgttgaacatctttttatgtgcctgttggccatttgcatgttttagttgaagaaatgccttttcaagatttttgcttttgtttcttgtgcttttggtgtcatatccaagaagtcattgcctgggccaatgtcatgaagcatttcccccatgccttcttttgggagttttacaatgtcaggtattatgtttaagtctttaatacattttgagtcgttttttatgtacagcataagataagagttcagttctcttgtatggatatccagttttcccagcaccatttttggaagagactgttattttcccatcatgtattattggcactaactataatggtgaaaagttaaacgcttttcctttaagatcaggaacaagacaaggacgcccacagtcactgcttctattcagcatagtagtggaagtccttgccagggcaattaggcaagagaaagaaactaaaggcatctaaatgagaaaaagataaaattatttctatttgcggatgacatgatcttatgtgtagacaacccaaactttcttatcttcacagaatattttgcaagagttgagctcctagaaaatgagcttagatcatttctcccctctggccagtaacaagatgctcctacactgagcttcatttagcacagccctggacacaccaccaggcactcagcaaacatcagacaatttccagttcaatggaaaattctcagttatccatggcagaatcatggccctgtcatgcactggctgagtttgcttgaggaagctgcttaagctttctgactcttggttttgttatctgcaaaaggggaatagcagtgtctataccacagggataatatgaaggctaaatgagatcctgtaaagcaatctttccaagtcctgagcttgacacaataataaaaactaacctttatttaattattgagggtggaggaaggaggataaagaacagaaccaaagaacagaagttatttcccagtgaacttaaacaattcatgagttttctcatcttaagcagggaggccttaactgcattgtctcatgcctttaaccagtgagagtcagagagagctaaggcacatccaactccgttgctcaactcccaggcacccagcaacaggtatagagcattgggagctgcactctccatactgatgttataattaatcttccacctcagtcaaccgatcatagagttccacttttggaagtgttccaacctgcacccaggaggcttctgcagtcttttttgctgccagaatgtcctccctgatttacacctgacttcggcaacatctgagcattcatatctgtgctacatgctggctgtagccatgggtctcattctaaaacatccttgccttcaaatacaggcatgaggcaggagtggaggaaggagaggtaagaaactattcatcggccgcctcatgggcatgctgacggcaagagttatgaggtgtaaacctgggttcacatcttgttttcttctccaggtgagggtacttcatagagctcagaagaaactcaaggaccagctctctcgggctgcccctgtaatatggcccactgagggcaggttcctggctgcccttggaacagtgctgcagtcatcaggtggtgtgaaagacaaatgcctttgtgccctcaaaggcaaccagtatatatgggaggtgctgtccccccttctgccactcatcagctcatggtaaacagaggccacttaggcaccactcaaggcattgaccagtctgagtcctaattatagggtcctacttatagccattatgaacctcaaagccaaacaagatgaattttgtcaaaggactcctcctggctttagttgaacagaatcatcagactaggaagccattagtgaccttcgtgagtttccagatcttcattctcatggctcttatcagagatttgctctgaggtgatagtgttatagggccctgatgcaaaaagcccagtgcagattggcttacctgctgctgcatcttgattgtccatgggtggggtctactcctgaggtcttgggattgaaaaagttcacacggactgtaaatcctgccattgctactgatgacacttgtacttgttgcggtgtgtccattgtagtgggaagagctctgctcttagagtgttatacagcctatagggtttggattcttcacatttggttggttgactttgagtctcagcactttcaattgtaaggtggggacagtacaaacttacagaagttattgtgaatacacaaccatccaagtaattacacctgcagagctgactagtttactttcttgcttgctgtctggtaaaactcttgccaatcatagacaaacgatcaatgcataaggtaacctcatttgagagttcaagttctgaacagaagaaaaggatctcattcctgttatgaacagcttagttataaagtcaaatgtaaaatcaaatatgtgtttctgtggcaaatggttaaattcttaccttttacaaaacattcagtagtcacaaggtctttacacacccactgcttatccatcatatttatatatggtgtgcctgttaggtaagacatacacactttggttagttacttgaatagatcataaaattaagtctaggactatgttttctgctttatttaaattttctcatccaaggaaaaatttcataaagagtggttaaatgaatgaatgaatggacatttactgtcttgaataaaacctttttatataacttagcttgttttgcaaaagaataaaacactgggttcaaactctttatttttcattgatctttagaaatcagggtccctcttttgaatacaccccttgctcaaggaaaggaaccatttatgttctggccttgattactgcacaatggcttttactacatttgatttgcagcagttcatttgtgattaaattttctaattctcccagaaagtcattgaacaagcaaacagtttactttccccaataaaacaaaacctaaagtatttggtctttaataaatgttcaaaaattattttctcagtgtgtgttcgagatataaatatcccttcatctcaaccgtcttttaaatatttgaccaatctacctttacagagtagttgtttctccttatgtcatttctgatctatctttcttgaatttttctttgcttagtttttaatcaagccaaatgtttgtttaatcagatacctcaattagtcaagacctgtctcttttatcagaaggtgaatttagagaacaattctaaaacatagggtaatacaatttttttaaaagaaaaataaccaaattctaagctcagcttggtcccagggcaaattcactcctcattcttaattcttcttctccatttctggtcacgggaggggcacccccaaaatgctgaccctaggactccccaagatcctccagcatccaaaaggcctctcttctccagtctttactttctatgggaacaggttgaaacccctgggaatgaatacattctcaactaaaaatacaaattaaaagaatttcttgcttagactatcagaaacttgatctagtgcacatatttcccaagcatttcatttactagatctgattaagacactctgttattgtatcatttaaatttttaaattttattatttaaattttaaatacaagttttaaaggatggttacaaattagtaactcaaaataattgagtggagagatcaaggtacaagacactctgcctttaccttcaaagtctgagcaaatatgattttatatcgttttaatcagagattcttttaaagaccaagttactgcagtcctgtcttgttcttctcctattttatactgatgtgctcagtaccttggtgtctttgtctgtcttttagggggaagggaacccacgttttggactagagtagcacagatgccattcttacctcactgtaggtttctttaaagaatgtttagtcctgacaatgcgatgcagatttctttctctccccactctatcttctcttgcagagctttatccctttttcattgttcagcatgactgggaacctgccagctcgccacaatgaaacataatgtttttgcaaagtgtgtgtcaaatgtcgtgagcttagaagagattcatcgtagagactgctgcttaatgagtgtaaattaactgatcatttgctaaatctgatgtgcccagtggtgtgggtgggagaatgctggataggatgtaggagatgcaggtgagcagacgggtagcagagacacataccgtgtttctgagcgaggactgtagcatggccagaaggctgttctgatgtagagagggattttccgctcacggtaggacccagtaccatgagactgaggactgaaacacaaagttaacacagatctcccgaacagtctgctttagggctggagcctgctgggatcagtcctcttgagaagaactacaatctggttgagattgaacttgccaaagacaatgagactaaacaagagatgcctgctggtaaacatcaggggtgttgtgtggaagctgagggaggaagaaaacacaaaagctgtgcatgatgataaggctagtgggcctagtgttaccagtaccacagatctacagctcctcctagaggcagggcacattcagaataagcaacagggagctgcatgtcatgtagtcaagcaactgtatatttcttcttcattgatttctgggacatacatatgaaatatcttcagcttcatatctgagatggcaggaacatgacaacatattagcttttaggtagacacccgtaggtcttaggatgtggtggaaaattgggtgtcattttttccagataatcactggcatttttataaaacatgaagcccttcctaaagtctgtgcttcccagatagtagtgaggagaaataggcttgtggagaccataagggtttattttggagtgggtcttgtgaatttgacagtttaatagtcacgtggacgcacactgttgtttgcaggaggggccatgaacccctgccctgaatgaaagggaaatacttatgtccgtggtaaccagggccagtggcagccaggaagccaagacctggcctccgctgccactgctcatacaaaccaaacgtgtacatcacgtatgggatataggagaagcacatctgaagggctatggcagaagtggaaagaaggcaaaactcttccacacaggcaacccgtgctttccagacaaatctcacaacatcaaactagaagtattcatgccaccccctacccctgccaactagaactggctgtctgtgtcaggtcgtcatcttatcttagaacacatccattgatacatacactgtttcttcttccctattacctctgattctgcttctctaaaataaaagctgaccgactggttggaataataatacatataccacctggcattttacagttttacatcatctcaggtgatacaaccaggctatgatgcagtcatgtcaccatactctttaccagatgagatgcaaactcagaaatattaggaaatgtagctgtgatggattgggctataatcaacttgtgatgtgggagtttctcagaatctctttccctatatacatatggttccgagctagagctggccacagtgaagccatgagacttgggaggtgaatgaaggaggggccattatgctctggaggttttcatcgtgtaactgaacacaggtccggatgctcaccgcctgcagaatccagttaacaagaatgagttctggtagaaagaaagtgactttattcactcaaactagtaaagaacaagtggccgggttcccatccaaagcaaccacttcaatttggcagagaggaagacaggggtttaaaaaaggaaatcttgacgtgaaaagcttgcaagaattgtgctgagtacaacgtctgtgtaccttgttctggtggctatcttgggtcccagtttacctggatctcgggctggtgtcatctcaacaatggtgaggctgttgactcgccaccttgaagtcatctctggaactttgcaggtgggtctccagacttggttcatgtgtctcaagattacccccaggagcttctaaaaagggacataattagatgctagcatacaggtagatgaatgtgaagggagtatagatggtgagaaagggagggatgtggagttcattttaagacaaagagggaaaggcttctgcaatttgcttcaaggttatatcttgaaacgcacgagaaataagtaaaaagtttaaaatgcattttgcagttaaactgcccagttacaattggtcagaagtggtgagagacacagtggagctgacacagggtgcaagtttgtcttcactcttccttacccctgtctttatttcccgatttccagccctgctgacttgcagtgagtccagggccaccatgcgatgctgtaccccactcgacagacctttacttccatagcacctcacatcattcctgtaaaaggttgttactctataatattccaaatattgagagtttcactctcaagtttgaactctgactgacacattacctgtggtctccaggtgggaggtgatgtgttttttacactttataatttttttttatttttatcactcactatacttgactgtgttatgatttctatattcgtcattcttcctgcatcattttctctcttctttttttttttttctgagacagagtctcgctctgtagcccaggctggagtgcagtggtgtgatctcagctcactgcaagctccccctcatgggttcacgccattctcctgcctcagcctcctgagtagctgggaatacaggtgtccgccaccatgcccagctaattttttttatttttagtagagacggggtttcaccatgttagccaggatggtcttgatctcttgacctcgtgatccgcccgcctcagcctcccaaagtgctgggataacaggcttgagccaccgcgcccagccatctatgttcatttcaaaggggtcttccttaatgatagtgcccttgaaccaaaaattaaagagttgattaaagtagtagaaaatggtcatctatacaagtttcatgatttataagaactatggaaattgctccttagaaaatagctttctaaacatgaaaatacagttgattagaaacagtacacatgaggaactctggtttcatgcaaagttgaaggaaattcttgtgaaattaaaaatgcacccagaacagttgatgaagtctagtccaatgaaagggttttcaactgtttgatttccatcttgtcaaagaatcaacttttggttttggtgaatgaagtggtttggctgtttccccacccagatctcactttgaattgtaataatccccacaggtcaagggcgggaccaggtggagacaattgaatcctggggctggtttcccccatgctgttcttgtggcaatgagttctcaggagatctgatggttttctaaggggctttcccctttgctcgactctcatgccctctcttgctgctctgtgaaggggcgccttcctccataactgtaagtttcctgagtccctcccagccatgtggaactgtgagtctgttaaacccgttttctttataaattaaccagtctcaggtatttcttcatagcagcatgagaacggactaatccggtaatattctccactgtttttctattctctacgttatttacttctgctctattatttattgtttccttccctctgcttgctttgggtttagcttgctcttcttttgctagtttcgtaaggcagagtgtaggttgtggattcgagatctttcttccttcttaatataaatgtttacggctataattttccttccaattactgtttttattgcattccctaagttctggtatgttgtgtggtatttttgtttttattcagctcaaagtatttttgtgtttcccttgtggtttcctccttaatactttggtaatttatcagggtgtttaatttccaaatattcttgtgtattttccagttttccatctgttactgatttctaaattcattctgttgtgatcagaaaaagacactttgtgtgagttgatttcaaccttttaaaaattatgaagacttgttttgtgacctcacatacagtccattttagagaatgtttcaggtgcactggggggacatgtgtattctgctgggcttggcagagtctaataatccctaatatacctcgcttctaatgtaggtgttcccaccagagcatgccagtgtcatgtccacaataacaaacaaaaattcttttttttctttttctaaagccatattgtagattcccagttcaactataatatatattattttagctatctatttaaagtgtcacatcatcctagggacctttcaacggactgactacatttctcacaattatagtaattactgaaaataaacacatgagactattctcttcaactaaaatatcatcttattttacatttagtacaattgagaaatttgcatgtaaagctaaggaaggacacagctttagaaacaatggactcatttctctccagacctatgtgaaagttggtttgacagtaattaccttatgggagcccaaagttatgaaataaggatgaggaatgattgttcccatcacagacggatcaccacatcatcccctgtgcatttgcatgttgtgtactgatcagaggtggcgtggtgtggaggggcggcagtggtgacgtggaaatgtaaagaatttcgtgtactgaggatccagttaaaaatcacactggaaagagaaccacatatagtcaaggaaagaagaagtggcctacaaacctgtgatatgatcttgaaatgacttattttaacaagcatacctcccatctattatataaaataaaccgaagttactagaaagagatgggggttaaattccctatcacttactagctgagtgactttgagcctgtttcctagtctctgtgagcttgtgtttcttcatgtgggtaatagaagtcataataatactcactttagcaatttgctgtaataattggcaacaatatcttgaagcacagattataatgtccagtatgtaatagccctcttgtatgtcgctgtattctttctactgtccatagttctttaggttattagactgacttatgaactttgagcgctggtcatcagacctacttcacatggagcctcgagacccctccctcgaattatcagacccttccccctctggccatcatcctcctccctctgatcatcactgtgcgccctttgaccatcaccctcttccctctggcatcagactctcctccctctgcccatcctcctcctccctctgaccatcaggcccgccttacttcctcataccagcagccgtggagtggatcttcaacaagcagccaacagcagccagggacagatcctcgggcactgtttttctgtccgaaaaatcagaatcgtatcaaagggtcggacacctggactggcaagacacattggggttatttataacaggggaaaatgaggtctccagggaaacaaaccataataaagaatatgaactcccgcagaccgaattgccttcaacgatcctcaaagacttttgtgtttgaccaatatcaattaattacatcagtaaataactgcctgagccttgtacttctgtcctcccaagatccagaatgacttctgctttcaaaatgaatttcagggctttctttgaagcagtcttgtaaagttgttatatttagtttaaattcaattaaagctcaatctgaaagctctttctgaagcatttgttccacatttacatgaaggtatttgctcttaaaattgttaggggtatagctcatttctagtaataataagtggtatttcataaaccaggatacatgatcatttacttcctgatagcttgcttctcccagatctaattctattcttccttgagggctgttggtgccagtgccagggctgcaaacatcagggttagactggagagtgacccgtgtgctccttcacccctgggtggggcctctgtgcttatcagtaggctagcaccaggtgcaggagacagatgtgccgcctgctcacagggcttacctgggacaaatgtgccgctcgctcacggggcttacctggggacagttgtgctgcccgctcgtggggcttacctggggacactcactatgattacctgggacaaatgtgccgctcgctcacggggcttacctggggacagttgtgctgcccgctcgtggggcttacctggggacactcactatgattacctgggacagatgtgccacccgctcactatgattacatgggacagacatgctgcccatgccggggcttacctgggacagacgtgccacccactcactatgattacctgggacagacatgctgcccactcactatgattccatggggacagacatgccgcccacgcacggggcttacctgggatagatgtgccacccactcactatgattacctggggacagatgtgctgtctgctcacagggcttacctgggaatgaagttccactcctccacttgcttagttcttgtttatttgtctctcccaccatttcaagtctttgctatcatcatgaagaaatatgcagggtgctggctgtgcagtgatgagctgggagaaaatgatctgtgacagagctggtagttaaggaagaatcccttggctgaagcagagtgtaagggatgagaagccaaatgggtggagagcgggagcaggggaggagggtgagagcatgagagggacactgcatctccagaggctggagaggggcaggggtgcagcttgtcatgggacatgtaagagggccagggactgatgcagagagggacaggaagcagcctgcaccggcactgtgggagcaggcagatgggaacgtggacagggagttagtgttttctcctaaatgccatggaagacattgatgtattttcaacagtgcagatagaaagcagtaaatggtttcaaaaatatcccaaacaatacaatatatagaatttcctgatggatttgacttgcaaacagagtggaagaaagaagtatgatggcatctatgctttgtgctttttgagcaattggttgaatatggacaccattttctgtcactgagaagactcagggaagggcgggaggatgggggtaagtgtgcagggccggtgaaactgggagatccgtgagatgcccaagtggcaacgtcagctctgaggaaatgacactcagagacatggcctggactcgaaataaaatgtgggagtagttagcacacagattatgttccgaacctggaaatgaatgaccacacctaggaagaaaaagcaggaaaagagaggagagggcccttagagatcccaacagagggggctgaggtgtgtgtgtgtggtgagttggaggacagccagaagaaaagatgacgttccaacagctgagatgcagtcagggcgcagcccattggtatgcagcgtggaggtctttggagacatcactaggaaccgtttactaaaatgtcactaggagcagtgcctgtagaaaccagatcagggcacacgaaagggtaaatgggagacgagggagacatgacactctgctgtgtggactcagaaacctttctgcaaagagaagccaggaacacagcaggatgcaaactaagacgtgaaaactcattcttcgaagtcctttcagagtcctacctgcttctgtttatataccgcctacatttctgaaaattctagtgtaaaacaaacatgtatatattaaattacgttccttttacttttgttaaataaaaagtagtcgcattagagaagagcaaagctaagaaacataatgaaatgatgtgtaaggatcctaacatgaccactaaagagcaatgcacctgagtgtgaacgcatcaaacgcttccaggcctggcagtcaatccatgtgccatggcctcttacaaggaagtcatcgttctaacaccccatcggtagggcacaggctttggttattttatcagtgcacaaaaatgaattcacactgttactggctttcttctgctggtgcacattaggtgtgatggctccttgggcttacggatgacccctgtggctagaggcgagggtgaagataatgggttcacattgcacagattaaagcagagactctattgtgttcagaagaacctagagttaatgggccacaaacagatcatcttctggcctccctagcagagccctcggttgcctcctgacacagtccatttccactttgacacaagtgtttgccagctttgtggtacctgattattagggtcctcttagttctgtgattgctccaggaattcggtaaaaattgtcatctggaagaaccaaattgcagttcttaactgggtagaattcaggctcttcaattcttgattccattcattacgtgctcactgtaagaagtggtacctccttgggatattgaatcagaaaggtattagagaaagggctattcatggtgtagggatctttggacttgaaggtgaaatttcaaacatcttcaatattcattttggttctgggagaggtaggaaaactgtctagaaatggtccatttataatcatatatgtgaatagaacttagcattttggttggttggttggttaaatgtgtgattgtgaaatagggctatgatgagttgacataaggggaaatcgacctttaagtagggtgaccatataattttttatccaaatggggtcatgagagagggaagagtggtgctattaacattcacattgagacagatgaaaacattcacgtccagacagggaaacctggatgtgctgtcatcttatgagggcttgtcatttgctaggaacaatttggtggtcgtttttccttacacaacaaggagagaccaggagcctgccctcttggtagatcagctaaacatgtccacaggattttgcttccaagatgaacatgggtgtagctttcaggagtgtccatcgagcatcacgattcgaaacctgaattttcaggggcttctctgtcttgtcaccttcctttgctgcatgcttcagtctctgcttgaatttgcacctggaaatggggttgaaatacatttggtgcagaacgatagcatttcaaacctgtctaaacagtttgcagacattaaaaaggatttgtatgccaagaaggaggcccctagctcatggggccagccccagtttgccttccgaatatactcattttgctgccgttaaagactttctgtgtaatttgagtcaaaatatccctattttctagttataccgattttcttcacttctaaaccccaagccaccataacacttttttcaaagtctgttttgctcttcccaccccttccagctccttgggggatttcaagatgggattgtggagcatagttaaatccatcgtaattacattcagtcagctgtatcccctcttcttctttgcctttgggatttcactactttaaaaaagtattctctgttgctgaacaattaaacataacgctaaccttgcagtcagattagccataatgaatatggtgtgggcatttgatactaagttacgtcattttaagcaattaaattaatatctcaaagtcaaaaagctaattccaatgattgctgtagacattttaagaaaatattttccaagagaaaagggatatcaaaatataaccatttttcttttgccaagaatacattgcatttgttttaggtacagataagaggcattttaggtatagattaaaatctgtggtgaggaaatgtagtcaagaaaagggctttacttgcactggagaagacttcccctcatgcacggccctcactaacttggagctgagctgcttgctgtacacgagctgtgcatccaagtgagcctctgtagtccagcccaggactgctatctgctgttgcctccggctttctggtcatgctgggggagttggggtaaacaggagcagcatctcacacacacacacacacacacacacacacacacacagacacacacacacacacagacacacacacacacacacacacacaaaacagctctttctgaggttgggaaggaatcattctttccaatggcatcgttgcccagcgttggccagactgtgatctgtttctgtccaagaatgaagacagctttccctttctaaagctgttctcagctgttccctcatttcacaagctgctttccagctctgatgtctgtggttgctgtagcagcaggctaagccacacctgacccacagaaggacatgaggttggttctacctcacagagagaagctgaaatctttgttcctattaacacaaagataaggggctcggaagtgtgcctgagcgaatgggactgacagtagcaatgacggtggaagaaagcccaagaacgtctccacagagggatgcctggcaacacaggagcaggcccacatggccagcatctctgaggtttaccttacccgcaacaggcacagctggcctctctgccccatgcatgacttgccacatccctgaaatacgaattgcatgaattttatgctggaacaagctgcagagtgatcagtcacatttgcagccctgtggactatggctattggaccgtacaattaaaattaagtttgacattaaatctaaaacaaaattttttgaaaataaaaaggctagacatggtggctcacatctgtaatcccagcacttggggcagctgagatgggagggtcacttgagcccaggaattcgagactgggcaacatagtgagactgtctatttttctttttttgagacggagtctcgccctatcacccaggctggagtgcagtggtacgatctcagctcactgcaagctccgcctcctgggttcacgccattctcctgcctcagcctcccgagtagctgggactacaggcgcccgccaccgcgcctggctaattttttgtatttttagtagagacggggtttcaccatggtctggatctcctgacctcgtgatccacccgcctcggcctcccaaagtgctgggattacaggcgtgagacaccgtgcccagcccaagactatttttaaaaaatacatttacaaaataagatacatttaaaagtaagttgtctcatctgacggcagccttgcctgggacactgctccaaaggcaatcttagcagggactcaaatctgattgttactgctgggtcttctccctgaccctgggaggtataactacagaatcattcatgcagcatttgcaacttaccaaagggtaactttccacagttcccagcgttagcttagcaaccagagctgcagaatatgccgtcctgggcagaaaagggaatggtgagtactgtcagttgagctttgcatcttctctaccttgttgaggacataacatctccatcagagattcttacaaacccaccaccccccgacacacccccaagaagaaaagcctgggaagttctttctacccacatgccatctttagaagttctccaactttatggtagaggtcatcccgtcctggaaatgtcagagaggaagattatagaagctggtcaggaacttaatgaacatttcctgcaatacactcattgtggctagtgtcaccaactttaacaagtgacattaacaagaggcttatctagctagcctgagtcagttttgtgcctcggtgtgaaagctatttctagtaccattttgcttatagccaggaatagttcatatcaaaactgtggaccagagttcatttttagaggacagagctgctaagcagaaagcgacagggggcccaacctcaccctcctagctccttccctgttgacttaaccttttgaaaacatagacatgggccaggcacggtggcaaacacctgtaatgccagcactttggcaggctgagataggcggattgcttcagcccaggcgtttgagaccagcctagccaacatggtgaaaccctgtctctactaaaaataaaaaattagcggccgggcacagtggcttacgcctgtaatcccagcactttgggaggctgaggcaggtggatcacgaggtcaggagattgagaccatcctggctaacacagtgaaaccctgtctctgctaaaaagacaaaacaattagccaggcgtggtggtgggcacctgtagtcccagctactagggaggctgaggcaggagaatggcacaaacccaggaggcagagcttgcagtgagctgagattgtgccactgcactccagcctgggtgacagagcgagactctgtctcaaaaaaaaaaaaagaaaaagaaaaaaattagctgggcatggtgacacacgcctgtaatcccagttactcaggaggcggaggctggagaattgcttgagcctgggaggcggaggttgcagtgggaggttgcagtgagccgagatcgcgccattgcactccagtctgggtggcagagtaagactctgtccccccacacacacaaaaaaaaaaggaaagaaaaaaagaaaagaaaacacagacaaattcaaagaggacatggaagcttaagctagaagacaaagaggaactagtgaggggtgtgtgacatcagccaaagctgttggcagggatgtgtcctagaaggcagaactttcagcttcctcaaggtcgttccttagtcgttgccactgaaaaatgggtctcgatgggactttgaaaaaaacagacccggcatctagtgagttgctgaaacttgccagctgtaagatctggagtgtttcttttaaactgtaggccggtttcctcatctgtaggattatgtcacactatctaccctgatttcataaggtaatgctatgtgagaatgctctcacttaacttggaagaaggtcaaagcaggatgatgttactttcctcaattctcttttaaagactttcttgagtgctggatgccatgagggaaagcgtatccgaaacactcatgtttctcatggcactgatctagggctcaggggactttgcacatcattgtgttttacctgatgtttaatcccaggcctgacagtggccctgcctcagatctcacgtcagatgggggcgggtggggaggacaaagccttccagcctctgtttctccagtgcagtcaacagaatgagctcctgtcccaagagcctgcaggatataccaacctgagagtcagacttcagcctgcagctccacaataaaaaaaaataaagcaagagtagcccctgcaagacgccaaaacaactacggagcagatcaccatggaaaatgcctcagccagacatgtccaggtccttcagaaacacattgctcatagagaaataagtttttgcaggtgtagtgagagtcaacatgaacataaaccaggcagttcgtcagtggccgattcagaagccggagccaagggtcctgactgagggaactgaggcacacacctttactctctgggtcttagctttaagttggggagagggtgggttagatctctgctttccacaagttctaaaaaatgttcaaaggcattaagtaggggaaagatgatctaataagtttggaaaattctggattcaatgcaatttgcttacttatcctaagatttagaagctattttaagctgaaattctccacggctcccagaaggggtgtgatatgcagttttagcccaaacttaccttgccatgatatcttctttccaggaacgtcagttgtgactgataacatgctggacccgtgttgggaaaactgaactggatgatctcaaaggccttttcccttcagatattctctgactgtgactgcttgaaggaggccaagaattagagtttcatgtcagaggccctcattgctaaagaagtagaggctcagtgtgattgggaaggcccacgtggaactaggtcatccccttcagctgcttcccaaccactgctctgtaattacaatgtgcatccaggaagttatcaaaatcctgtttggagaatattggattagcagaatgtttgattaaatcaataagtggaatactaaggggtttttctcttactaattacatctggaggaactaacctcgtctgtagggatagactaggaagctatgtttcttatgtaaatgaagatagcctaaggaaaaaatatctggaaaaggtaccctttcaactctgatttgtaaatgtcaaatagaggtgctcaaggagaaaagaataaacaatttcatgaaactcaacataaattctaattataataggaatagttgaattcataaattgtgtactctctgaaaagttaaatattagcctgaaaatacaaaaaggacttggatatttcatttttacactcttacatacacacaactttttcctcccaataaataaaacgatatttttgagggacaaatttggcaagttttgcagatgagggtgagaccttattcacttcctcctaaatttaacctaggttaagaatattttcagtcactatttgttgaattctaggtcttagtgttctacctggtcacaatttgtattgagacagaaaccagtgaactcaaatcttcatcagccctcattatcagaaaactttggctggacagctgattgatttgctggttttactgctggcttaatattgatctgactatgtatttcccttggctcgctaaatatatacaaatcaagagaggtttttgatgtcttaaaaggaaacgagtaactgactagagttattgcctaagacccaatatgcaattcagcttaacccacagggcacctgccatgggccacttaatgaggacaccatccaccactgctcatgctgcaagctgccaatgcccttcttaccccttcacctcatttaccccattatctgtaatctgaaattaccatcacctcccctcccactatattttttatccctctcttcttcctcctcacttcccatgacgacacctctgcttcaggtcctcatttcggttcagtagtctcgaaagatctctcttcccattctttcttcaaatgcatcgtgtcctcctcagataaaaagatctttcttgtcttcagtgggtttccactgcctaaaggataacatccctattccttattcatcaaaaaatcttccattgggtggccctgattatctggctttatccctcactgggccaccaggagatgccacacgtgaaaccacatggcacagctccccctcccggtatatacagcacgttgttgtgtctctgccctttggtcaatagtattctctttccaagaatgccttccccacacttttcttctagcaaaacattgctcattcattcaagcctggctcatgttgctcctctgtaatgctatcctactttgccttaaatgaccactccttcctttgtgttctgcactatattgtttatatcgttgtccgttggattcatgcatgtctcttttgtcactagcagtgatatacataaacatcccaaaaaaaaagtagctctgggacaggaatgtgtcagaggccttagaaatggtattttatttagtctttaaaaataagtcatgttattatatacctcatagaaacaggctcacagaggagaaattgaatgccccaggtcacatagctggtcagcagagctgggattcaacccagctgctccgtgtcaccctttgcattgcttcctgttacttctccactgttatcccacctgagcctgtgtgccttcctggggattagtcaatgtgagggtggctccaatactgtgtttctgttgttctgaagggctctgttctttgttcatcctttgttaggagatgtgaagacattctgagggagtggaagataggctgcccatcctcagggctcaagagctggagagaggggataaatgaggaagtgctttgaaagtggacacaggatgacattagttaggcatgaggcataatactgctgggagaatacaggaaagtcattctccttcgacttcctcacattatagtttttgtacaatttggagttaatcaaagagtagataaaccgagaaaaatgtgtgttcaacaggaaaaatggcagggtggggctgttctaaacctggggcagcagttccccactgtatctgggacagagtcatttaatttcagtagtggcttttgaatctgtgaggcccacttgatcttctactcctatcagctcagtgactcattctcccggcaaagacttggcgtcatcccagggaggcagagaggccaactcagtggtacccacaggaccgagtgagtctctcacaggctgcatccacgccccccatggcctctgctaatgaggtccacacctctgctcagcagcctgccaatgtgatgggacacaccccatgctggaagagctcccaaaccagactttgtggaaacttgtggctgcaggttcaaaaggctaatttggttttccactgtgcacagggctgccactcagtgcagtcttcagattgagaacacttcctcccactatgggcagtttggcgtgaatgagtgagatacgtagtttctggatagcacccaggggaatgccgaggatgtgcacacaaagcaaggctgactgttcctttgctgtttgtctactttttcccattttgtgctgagactcatctttccagcacaaacaccagggtgaggaattggaattttagtgctggaagtctccagaactatgatctagtgctcattccctctgatcccattgccctgacattatctgatgcttccacagctccttgtacagggaggtgtggagttgggagagcagcagcctgtggtacagggctgcccacagggaaggaagaagacatggcggggacatggcctgactcccgatgtgctccttcctgtagggtcttccacatggctgggctccctcccgtcccagcacacatcctgggtccatgtgaccttgagcttcacaaggtcaaatctgtgcagatccaaatggtgtgtggatctaattttcttcctcaagaagccttgcacaatctggccctgcatgcttcctctgagcccacacttcctgtgagcatacacttcctgtaagtgtatacttcctttgagcgtacacttcctgtgagcttacacttcccatgagcttacacttcttgtgagtgaacacctcctatgagcccacatttcctgtgagcccacacttcttgtgagtgtacacttcctataagtgtatacatcctgtgatcatatatttcctgtgagcatacacttcctgtgagcttacatgtcctgtgagtgtatacttcctgtgagtttacacttcctgtgagctctcacttcctgtgaacccacacttcctgtgagtgtacacttcctgtgagcacacccttcctgtgagcttacacttcctgtgagtgaacacttcctgtgagcccatacttcctctgtgtatacttccagtgagtgtatacttcctatgagcccatatttcctatgtgtttacctcctgtgagcccacacttcctatgtgtacacttcctttgagcccacattgtgggtgtacacttcctgtgagcacacacttcctatctgtgcacttcctgtaagcctacacttcttgtgaatttatacttctatgagcccatagatcctatgtgtatacttcctgtgagcccacatttcctccgatggtatacttcctgtgagcacacacttcttatctatgcacttcctataagcccacacttcctgtgagctcacacttcctatgaggccacacttcctatctgtgcacttcctttgagcatacacctcctatctatgcacttcctaagagagcatgcttcccgtgagcccacatttcctatctgtgtacttcctgtgagcatacacttcctatctgtgcacttcctgtgagcatacacttcctatctgtaaacttcctgtgagcatacactttctgtgcacttcctctaaacacatacttcctctctgtgcaattcctgtgagcccacacttactatgatatacacttcctgtgagtatacacttcccatgagccccccttcctctgtgcaattcctgtgagcacacagttcctctctgtgcacttcctgtagcaccactttctctctatgcacttattctgagcacacacttcctatctgtgcacttcctgtgactgtacacttcctgtgagtatacactttctgtgagcccatgcttcctctctgtgcacttcctgtgagtaccactttctctctgtgcacttcctgtgagcccacactttctgtgagtgtacacttcttatgagtatacacttcctgtgagcccacacttcctctatgcacttcctgtgagcacacacttcctctctgtgcactttctctaagtccacacttgctgtgtgcattctcacctgcacaatcactcttgctcttggggttcttgcacatgattctttaccaccccagaactctggaaggtgttgctttctgagacctacctctcttgtgtttctccaatgccagttcatccatagatttcttcctaaataccactggcctccctgtgcagtgctttcactgggacctgtgttttttcttggtggcacttacatagaaggattgttgtttaatgacagtcgactccaagactgtcattggtagatggtggcttccaaaatggcagaaccaagtcagccttgttctttgtggtatctccagggtcagccttccctggtgttcccaaatgttccctaactgaaaggatgtattacagttgggcttcctctccctaggagacataattaaatttaaaagtgggcttgggttgtttgtagtatgcagttttttacaggggaaccacagaatctttattccagatttttgaaaaggtgcgcggtgcatttcatttagtccggtaagccgtatttttgtgttctgttgtcaatacattttcagacacacatcacttgcgaaactcctaaaatcttttcaaaatgctctcacaagcacataaacacatatcttcttccttattactcaggcacttcagacccagagaattgcttttagagatcttgatcataatacctcaaagacagttttctttaggaagataaagaacactaaaatgttaataatagaaccttgagaccctctgaaaagaagacttatgtcagattgataatttaggtagagttctggaaaacattaatctacaaacatatgcctgatagaaggatatttgcagaaatggctgcaagtgcaatattgttccagctggtgagtgtggtccataaaaattcagtctttaaaaattatagtatagtctaattgtaggactgtgtgctcagtgaaaatgcactttacctatagatagggttgggagaaccaccctgtcttaccacagtgtatgtctgctcaacacactgccatgacctgggaagagaactttagggggacattcttatgaagcccttccctatacctttttgttagttccttataatcccagaaattttttattagggtagataaatgaccataaaacgtttccaccccgttgaggatgtttcttaggacttcttttatgacaaccatctaaactcagccacatctgcctctggcgtgtctagtttggggccacctctttgcatccccctgtgtaattattttatgagtgaagtccctgctggaaaccagccctcttcccagtcaaaatccatctgtttctccactgcctgtacatgcctttctctttacaatacagttagaccatttgagtcaccttctctagagagataacacaaaagcagaatcacagacatgtgcaatcttccagtaaatgtcttccccccatacaccatgtatggggttgaaaaatggtatttctataaaaaattggaatctgtgaagacagggttacagtgagaaatattaatacacacattgcagagcaggctggtgtcaggttctgtgccaagggtctgtggtgcctctgacaaaggagaacaatgctgaggggacgaagcagcaggaggagatggtggggggggtgggggggtggggggggtggggcgagctaattatccaaattggaaaaggcccaagccccttggattaacacacatcttccctgctgaagaaagtgctcagggaatgatcatgatcagctgccatgacctccacttctcctctcacagggcaccaaaccaacatgcatcaggtggatggctgttggtgatttacatgggaaatgactgtggtatgcagggatgcaaaatcagtgtggcttcttcctccagaagtatggggccacccttgcctcaactcataagaatacactgatgttctggtgttgcctcagaggccttagcttacacaattcctggggtcagggttgggtctatccaaccctagggtgtttctgcagaaaaacatagaccagtgttcctaagatgccagcctggcttctgctcccaatctgcttcctctgaatcatacctcttctttgcaaacgaggtgtttttgtgaacagaaaatatgtggacttgactgcttcatttactctctcagaagttcattaaaagcttacatacacaccaatcaaggctttttatgagacacagccaagatgttttatgtgtatggtgccaataaacacacttctccagaaggaactagtactatttatgtaaagtagacacttaattcaactgaatggaaatagcaaattagagaatgcttgattatggcattgaagatgctttctgggatgaagacattatttggaaaatctccagatgctcaaagcttgaggaatgctgggatcaggcaggtaactctgtaatagaattggacagagactaattctgctcaagaacagctcaaatggaaagctcagatccacagggaaggagccaacccagtccctttaacttggctatggtggatcaagatcgtcactggaactctttggttgtgagactcaatatttattctgtgtaggcaggagcatattggacccatcatgaaactggtactgtcataggctagacctgtgacctcctaggtgaaataacaaaggctggaaagaggtgtccccatgggctttggggaagacttctcttgcccaacagtgagcttgagcaattacttttctaaattgattggtttattaaagaaatattaattggacaagacaaccatcaatgtgaacctagttcaacacaaagaacattcaggccatcagatgaccaaagtgaagcttcctggtacttagcatctgccttatcaactcaggcctgacaaggaaacatgtcagttgctggagaaacacccataccctaaacacctcctgtcacacagtggcaacctgaattactgtgaatccatttatgcggctctcttctctaagagcagaggaagtaggtgtggccagactcagaggaggtcctcaagcaggaggtgtacaagtcagggttctccagaggaacagaaccaatagaaggtagatatagacagatacagatatataagaggggatttatcagaggagttgtctcatatgcttatggaggctgagtcgcatgcaggccatctgcaagctatagaatgggggaagctggcagtgtggctcagttcaactctggaagcctcagaaccagggaacctgaaggtgtaactttcagtccaaggccaaagtcctaagaacttggggtgccactggtgcaagtctcagagtccaaaagccagagagcctggagttctgatgtccaagagcaagagaagaagggtaccctagctccaggagaatgggaaggagagggcaaattcacctttcctctgcctttttattctatccaggaccttaaagtgattctaatgccagtctcttctggaaacatcctcatagacacacccaaaataatgctttaccagctatctgggaatcccttaatcctggcaagttgacattggttaataaaattagccatcgcagtgggtcagggagaaggtggccgagtgtctgcttcctgtgcggagggcaccacaccttctgaatgacttcttggtccctcatagcctaagaagtccggtgaaatgcatttgatctcttgactactttttaccccatcagttgtaccatccaccttccagctatcttcccacttcatgcccatgattccatgcactatttatgctggagcactacaactaagaagtctcttttgcatttctttcttccctccagcaacacatggccctttatgcagctctcacagccagtctgtatgagagacagaaataatggcattgcccttgggaaaggagaaacagataaagattccttctcttgacttctagcggcaagcagtgacaaagtgccccacaaaatttaaagcatcaaggagtagcccgtgggaagatatccatcagatcctccaatatgtgaattaggtctgatggggggtagctgctcactggtcatgatatcttgggactcctgcttctatccagcccctacatcgctctttcatgattttaaatgtgcactcaaggagctcactccaaatccaagcctacatgtatgcctaacctactccaaccagagagctccatatttatgtgaagaaaagggccatatctgattaaacaaccatgattctgtttgcaaacaccaatccacacattatgaaagacacagcaaatgtccccaaataattgattttattcacaccaagtttactctgacggattaccacaagtaaacatgtaaacatgggtaacacttcactatagtatagttcatgccacttgcctgatagaaaaccatggagcttctcttaggaatccattttggttttggggtttgtttgtttgtttatttactttttttatattaaaaagagagatgaggtctcactatgttgcccaggttggtctcggactcctggactcaagtgatcctcccacctcagcttcccaaactgctgggattacaggcgtgaaacactgcacccagccaggaatcctttaaagtacaaggaggattcagcttattatagagccagtctatacacaataacctgaattatatacctaacatgatctaaatccttagagttttagaaacactcaaaaatttttttaagcctcatttctaataataacacagtgattaaccacaatgcttggcgaattgcctcaaaacctttttggaagtagggaggatataaataaatcagttaatacataaataaaatgcttgcagctcagcgaccttctggttctcaggtttccatatatcaaattatggattgaccccgctaagtaatctccgaagtcttttctatgtagaagtctataaattttctgttaatcccagggtgagttggggaccattttgtcttttgtccttgtcgactgtctttgtgagaagctgagtctgcttacctgctgggttcagtgagcaggtatgaaggcatcatgtatggacattgaagagttgcccagagataagctctcacgtttggagaagcatgggtgtgtgggctactgttggcttcagcttgtgtacaaggatattcaattttagaaagccataattaatagtttctcttcttaccatattgaagaagtcagcttgttgccttctggcgaattaaaatttcattaaacttttcagttaagaaaatacagcttgttgcaaaaacaccatatgcaccttacgactcttttccccacccctcctcagtgcgactcccatcactgcacaggtggaggcagtgaaggggatgccttgctttctgagctgctgaaaacatcagggtttcagttctgtcttgtttactgctctatctgatcaccttgcattgtgcttggcatgtagtagctgctcagtacataccatttgaatgaacaaatcaatcaattaatcagttaatcagccagtcgatgcaggtgatgcctgttcctaaattcctttggtcccagtaggtactttgcaacatttccctttcttctgcttctgttagaagggacctttttaaacttgaagggcagaggcccccacgcagctcatgcagatggtggtactaactggagaagcagttacagttgtacctagcatgcatttctgttggagctcatttcaagtaaatgacttatactttatgtccacagcaaagaggcccacatttgtggcaatcttggtcagtacagtcaggaaggaagtgtagctgaagatcactgaggaaccagagaaattagtgtatatctggatttaatgatcaatttgcttatgttaaaaatacatttgaatatgatttactgcccttcagttaatgctagttccttgcttgcagcaggaccaatcaaaaggagctaaaccttaaaacccagatggagatgttgaaggattctagctaaagtttatgcaattaattaggcatcccctattcagaatacactttctatttgtgcttagaattgaaagatatcgtactcccaggaaaagtacaaagaggaccacgagatacattgataatgaccttatccttaattcattccacacatactcagttaagtggcttaaataagtgatagagattttaatttaaatgcgagaatataaatgggcaaatatttgaatttaagtgaaattaacacaacgtgccaaatattgaataagaaactggaatttagttggcattggataatgtatttggtttgagatttgggtttccaaactgaatatataaatcaatgggcagatatacagtgaacacaaatataaataaacacagttccatgtttactgtttataatacgtccccccaaatatgtgcagaagtggaatgtgaagacaataaacaacttttttgttaggttgggggcaggggattctgaaagctacaaaatatcaaaccatttattcattgcatcccatctttaagatacagttttcatcaatatattttcaatgtttatacatgttacttagttctgttctttttctactcaaatgattgtacagttgattaatgtcacatggacttccattgtgattattcttttagctctgcctattcacattattaataaaaccatgaaaattaaattaatatgaccttatcattgtaatcactactttcatttttgcatttttctactcacttttaccaaaaaaaaggaacaagatgggaaaacaaaaattacataaaaacttcagcgtatggggaaaaacagagttgtctctaaaaaggatctgctctcggcatggtagcatcagagcatctactcaattgtcagccataaatgaagttcagaattggacacaccttcacagtcttccatatgccaaagcggattgttccaacatcagatgactccctgccatgtattccttgttagtttcctatgctaaatactagtaagataccaaaggatgttagaaatctgaggagaagttgcctaggatttagagatcactcctagtctaatatcagtaggtttttaggattacaggttattcaagggctgcttcctgtgtgtagaggttgtattatgagtcctgaaaggagagagaggaaaagagtctgccgtattcagaataaaaaggcaacaaagacagagtgttttgcggattgccagataagtcttttctgaccgttcccaatcctgaaagttctaacatggagactgcttggtctttgaaggaggtgaattgcagtaaacaaatcatgaattatcatctgcagtagatttgaaagtctttgagtgaatataactgggggatgtaaccttaactttcagataagtttctaaacagttcagcatatcattttaaaatgagcaatggatgtttaatgaagaaaatatgaaattcaggttatcatgtaaattacaggtaaacaaacaaaagggaaatacaaaagtgacctatactctaatcacccaaacagaatcactgttaacaagttggcaaaattctttctgggatttcctaggcatctatagtccaacttagctctatgtttatttaactacatttatgcatacaaatacttttctttacaaaatggtgtgactttattctgtaacctgctgctttgcatagaaataaatgatgagcatgttttatgtctctaactacacatttatcttgtcttaatggctgcttggcattcatttcttgggctatagcttcacagatttagctactagatagtctccaattatacgcaatagcacatatacctttgtgccgttttttgtacatatatctttgtacattcattaaataatttccttaggataagatttttcacaaattaataggtcagaagtatatatttttaatacatatgaggtgtgttggagaattatcttttagaaaatttatatcagtttatattctcaccagcagtatatgagggaatctgttctaatcagacattctcaacacaaggctttatcattctttttaattgttgccaacctaatagatggtagactctactaatttgcattttttgattacttactaaggttgaatttttttcatgtttattgacctttttctcttgcctctttgtgttcatttagccctggtatttggtatgatttctcctaatgctttgcaagttaataacttattcattaattcactcatttattcatttattcatttacttatctacatctctttcttttctgtgtgttgtaatctcatcccccccatactctgagctttaatttgatttatggtattttgtggcatataaaaatctttccgttttatttagccaaatttaccaatcttttcaattataattttagacctgaacaatttgggatctctgtgaattcagttattcatctgcatattcaagctaaaatagagcagtggcttagaaaccatctttcctaaaactatgacaatgccatttacagtaagagtcaatgaaatggggggagagtcattcaatgttcagaatagaaagatttagaagaatggcaaagttgagcatcatacctttatgaagtgaattgtgtccttctcaaaatccttgttttagccctcacctccagtctgactgtatttgaagataaggcgtttttttagggttacatgatgtcataaggatggggccctaatccaacaaaactgacatccttataagaagaggaagagacagcggagcttgctctctctgccctgtgaagacatggtgaggagaaggctgtctgcaaaccgggaagagagccctcaccagaaaacaacccctccagcaccttgaccttggatttccaggccccagaactgtgagaagttaaatttctgttaagactcccagttatggcagccaagcagactaatccacttaggctgatgcagtcaccagttctgctgggcacaattctaagatgcctcccaaaatgctcacttggccctggcgcctacacaccatctcccagttgtttactcaagcactgatttcagtgctgctgcaatgggatttggttataattaaggtcctggatcagttgccatccaaatggggagataatctgggtgggcctatttaaacacatgagccttgcttttagaaagacccctacagctagtcacagaggaggcgactagagagactttggatggcctctaggaaagcagacctccttgtcatgaactgcctgggggccacatgtaaagagctgcaggtgcctctagctgagagctaaaaggaaagaaagacccgagtcctaccaccacagggccctgagttctaacagccactgagcttggaagaggactctaagcccaagaaagaaatatagcccagccaaactcatgggaccctgagctgtgagtccgtttaagctgagcctggacttctgacccactggaactggaagataatgcatttgcattgtcttacactggtaggtttataggattttgtcacattgaaatggagagtgaatgtgtcagtgtttacatccctgcggagcaaggagggtgccagctacggaggtggagtagggggcctggctctgcagctggggcatcgcagacagcggtttggctaacggtgcagctgatcttcgcaagttcccaccctgctcctcatgaaacacagttgcgcctcgaacaatatgggcctgaactgcaagggtccacccaatgcatattgaaaatacagaattgaaggaagaggaaggggagtcccgcatatacagagggctctcccatacagatgagtggaaatgccaccgggtgaaatctgttggaacatccatacagaagcaaaatattagggaaacaacaggttacagaatcctccttgaacattttttctttcagagaagtcaagtgtgtaggtatttggagctaggctaggtgataagagggacgtaaggaatgtggtgtctgtcttacatgtgaatattgaggacccagtatctacagccacaaagtgacgaccaggtatcacccagcagcaaacttctgaaagtcacgctctgagaagcctctgcctccgatctggggccttcacctttccaggggcccaccccatccctcctcccagccttctgctacctgtctctccacttcttctacaagcaccctctccaaaactgccacatgttctcctgactttgtgtctctgtgggattgcctctatgatgtatcaggaggacgtgtggttcaggggccaactgaaacaccatgtcctttggttttttgtgaagccatcccccatttcctggaaccaaaatagatcccacagcacttcctgtgtaccctgatacctaacaaaatgttttaaagattgctttagctggagattcttacatatgtgtgtcctcctgggacagtgagtccggcaaccaaccctcgctgattctttccctccctccctgcctctcgcagcagctggccaactgccccttctccagcaggtgctccctgcaggcttgtgaaatacactggagggcaattgtctggctcagactcatgttgccatcagcaaatgaccacgtttaagaatgttatgccacctctatatttggcctgcattattcatataaatatgcttggtagacaagggacagaaggcacttgtgtcggagaaagacagtttaaagggcaacgacctaacacactataaaatacagggagtggggagtggggtggagggagcaagccgcgcggctgccaggcagggccctgctcccctgggtgcacttcctccctgctcccgtgggtgcacttcctccctgtccagggagtgcactcgcttcattgcccagtgcgactgggtctgctttgcaggggccatatctgtctgattgtgcttgggcagatttctcttgtctccacctagctggggtgattcaagtaggaaaaaagaaaaccctcctgcacagattgtgcgatcatttcatttccttgcctttgtttgtcatttctcctgtctgaaaaaacagggaatccactaaaggccagaacattgtactctgcttccatcctcatgaaatcttggcttttctttgcaggaagcgtccaaaataacacaggattggtcctggggtcccaggcaaaagtgagaggtcagaagggtctccatggttctcactcctctctctgtgaccttcactagctcacttccttcctgcccagttctcattctctcgtccagtcttttctttgtcttcctgtggatgaatacatgcataaacataagaataaaggcaaaagtctcaatggaatctatcaaactgttcattgttaaccactttcctgtaggttgggtgggggaggttttactttcactttattcatttccttccttccttccttccttccttccttccttccttccttcctttctttttctgtcggagtcttactctcgctcagactggagtgcaatggtgcaatctcagctcactgcaacctccgtctcccaggtacaagtgattctcctgcctcagcctcctgagtagctgggattacaggcacccaccactatacccagctaatttgtgtgtgtgtgtgtgtgtgtgtgtgtgtatatatgtatatacacacacaaacacatacctatatatatatatttaatagagaaagggtttcaccatgttggccaggctggtcttgaactcctgatctcaggtgatccgcctgcctcagcctcccaaagtgctgggattacaagtgtgagccgcagcacctggcctattaatttctgtatttgattttttttacagcacatgaaatagttttgatgtttaaatgaaggaaacaaaagcagtgctttcgatagcccaagcttatctttcctaaatgaacccaaacctcacagttattccctttacttcccactcccgatcacacttgtcccaggtggatcacgtccgagaccagcactccatgaattttaggagccagagcggaccgtgaaggtgtcctggtagctgaggtcctatggccgctcatgaaattttagtgagccatggcttccctgaggctgtggcccgcaaagtctgaagggagtcacctccttcaaatccactgagcaaggcctggggagtaatgggaggtcccccgtctgactcacacctgacagtcgggcctgtcccatctctggcaccagcaaccgcccggggacggtgagggaccatggggtcagcctcagactctctgcacatgtttgctggccaacgttccagccagcgggcctggactggagggctgggatggagagggtggggcaggaaggcagagcctgccctgagggaaccgggaggtgttccgcgcaggctctgctgctttctgacgtgtgaccgtgtgcacaggatttgtcccaagtcccacctgcctcttctggaaagtggagcgatgatgtgagcaggcacagaggtcacaaggagaattcagggatctagagacccccagagcttgccctgtgcccatgctgcagtgggcactctcctggcatggccacgtctgtcacgcgtgatgctcacagcctgctcactactagaaggctttaattttctgaagcagtgatatttaatttatttgaaatttcaaatgtcattaaaggagacgtgctatttttaggctaggaatttaaaatgcttccaaaatgcctcatccccatcgctcttattgcaagcatgtattagctgttctcacgcctgctgagaatgccctgtgactgaagcaggggctgcttctgggggacagtgcagccaccatgtgggtcaatataaggaaatcaggatgatacaagtgatgtgggtttgcaccatcatcctggctgctctgtgtgctgacgtgtgtataacattgacacgaggatgcctgtagcagatgggggtttagctagaaagcaggaggcagtgcacgatgagtatggtgcagtatctccagcagacctatgctgggcagaaacctcacagttctgtccaaagggagcttcatccctccgatggccattcccctgcagtccgtgaacccccaggatagctgcaccgcatcagcagaacaattgcagtgcctttacagtgaaggaacacaggctccagctgtcagctccatctcaaaacctacccaccccactcatcctgcacacgctgccccagccccatgccccagaggctgcccaagcacctagcgaagccctccaggatgcttggctctgggcctgttgtttcaagccctgccctgccttctggctgctggatggggaattgcagtgagattccttccctccgaagctccatctggtgcaacatctggagctggtcccccagcataggaggatgtgagtgggatgatgaatggcacctcagaagtgtgctgttggggagggcccacctgtttaccaacatgattgcaaaacttaaatagctctggggattctgaactgctcttcttggggggctccccaccgagagcattttaggccctgtgcatagcaggattataaaaaagtcatatttaagacttgatcatgcttctggcatttggaaggaaatggatggatgaagaagaaacagaaaagattatagagaactggaaaacaacaatttaactgctaggatatgaatcccaaatgttataggggaagttctgggatgaagagaagacggagcaatggctgccactgactcagtgatgtgtaggacatggggaagccgggattgtggacactccccaccgtggtaccccccgctccagtggtaccctcccccgcccccggcatgggcagctcagaccaccgggaaagttccagcaggcagatacattgcttcccacacaagctcattgggagaaggcggctctttttttctcattgttacaatatgatttgattcgtggtgttgtaatgattagcaagcagaaccaatgtggtttctttccccagcatcgcttgaatctacagcaaactgtccagagaagggatcacagtgggattctgatgccttattatgatgtcaccttcacgaggaggtttagaggtttgcttttgttttgctgttctaagaaaaaagaatgtgccatttggacatttcaccttcaatttggaacttaaaaatttagtccataaacaggaaataaacagaacttttgagagctccctctctcatttggcaaggccccccacttgccctcagcacttgggcacccaccttgacttacagaggaagccctggaaacagccaaggatgggggaaaccaatcctgggagcacaggggtactcgcctgccaacctgctgacctctgggaccaaataccagggctccgtggagacatggctttttctgggaggatatactgaaaaacagagcaaaaggggaattgtttgctgtgtgagattgccaagtcagccctaggaaagaaaggcccaagggcacatctgcagaaggactggagggtcagtctgagctcatatttgccaagtctccaaagaataggcatcttatggtctcagcacgagggagaagagagaatttcacctaggatggcttccagtaagcacctgtgatgtctgggttctctccattcccaggcctgagagcggctgcacagtcctgattcctggagcgctggcccaggccgggtcctccatgtcaccccctttaatatctacatttattcatgcagacgcggactctgagcaaagtatcaggagcctggtgattcaagttgggagaatccaccaaagtgctttccccaccaggattcactcacttgggcctctttggaggctcttcctccccactctcctcttaaaggccaggagagaggctggcaaggtcgcctgtctccctcctccacacctgttcctagatagctgcttcctgccgggactccgtgatcttgtctgcaatgggtccagatctgtagactgtcatctaacccctagattcctacagcggactgactaccattgtccgtgcatagcaagcttgtccctaaagctcagacgatggcctccccagtgcttccccagaacccgatgtggttttcagtagaggcttcttccatggaagctgccaatatgtgtcccacctgccggcattagacctggggcacctgattgcttctgcccgccccaggatgcttgccccaggcctctcccatccatccaggtcacctcctccctagaccttctcagcagcccctggcttgtctctgagctgcgggctttctgttcctggactgcccttcaccctgtccccagagcctcctcagcactgatctgattttgtcactgcattcctgtgcttgtaagcctgtgaccagcaatactgtcacttcttagaaaacattttggtctcgacacggttcacacaggcaatgccccgccatcattgcttccaattgtgttcgacgggaagcagacagtagcagcgacggctcttggtgctcacccagacctcccttgctgggaggttgccccaagaccctgcagcctgttactgatggaggcaggtacacacatagccatccccttgccctccctcagggaccagctgtgaagtacagtgcgtgcgtgcacttccagatggcattcgactgcagctggtctccagttgggaccacatcagtgcctcccgtctcccctaccccaggccacttccctccctcctcctattaacatcatgctccccaataatccccacagccccgcctcagcctctgcttctggggaacctgacctaaggcaacagcaacatttccctggggctgaggaggcaggcatgcttttaaagaggcttttccatcacctttgagcatcacctgcctacgagatcaaccccacacatttgagtttggcacatgacacattgcacggcctggcacggcctttctttcctgccttcatctttcgcctctctatgccctgttctttgagcttagcctggggttctccacagaaaccacactgttggactcttttatgccttggtgcatcctagatgtcacattacagtagtttggagagacttttcttaggtgtaagtgagataaaggggttgctggaggtgctggctacagggcagtgacagagaaagcagtggggtaggcttgccacatggaagagagcaggtgaaggaggagacataattttttcacaggaggcagctgctgcctgtccagcacatgaaccaggggtacagggatggggtgcgaccagcagctaatctaactggtgtatcttcacattgcatgttaccatcaggatggagagagcaggtgctctctggaccctctgtctcccagcctgactcttcccaagactgtgagcacctacagagcaggcctcaatccataaccttggtattcttgtgttgagttttatgcccgctgcaatgctagactgagatgcctcttgtatggaaaatatttcttaggagtttagcaaatttatgtcattggctgatatttcaggccaatccattttgggattagaacattatcaggatgtaaccttagagttcacttagttccggcaaaacctcttaacttcagttccctcatctataagaataagggattcatttgtgatcatatagctcaggtaatccaggaccagaaacccaggagcgtgggacctgatccacagctagaggatgggggactctgtagctacagcattttcctgaacacacaagaaatccagtaagcagcacacactggctgagtcggctttccaatcagaaacaagcccttgacttgccggagttggaagactgcaagtacctgcccaaatgtccacccaacagataaactccctgttacgtacataattacaagcattctttacctgacagtcccatggctggacaagccaagctaagttttcagtgtacataaaaagcataaaacccgatgaagtggcctgcctaaaaattaatgtgatggccgcaattgcagcttttgtggccctgacgttagtctttgaacgagtctgccttctgggtcaagtgaacttttactctgggattatagaaagcaaagtaagtgatctcaactccctgccgcttatacaagaggggagttgttacttttactttattttattttaagatggagttttgcttgcccaggctggagtgcaatggcgggatctcggctcactgcaacctctgcttcctaggttcaagagattgtcctgcctcagcctcctaagtagcagggattacaggcatgcaccaccatgcccagctaattttttgtatttttagtagagaccgggtttcaccatgttggtcaggctggtctcaaactcctgatctcaggcgatctgcccacctcggcctcccaatatgctgggattacagtagtgagtcactgagcctggccttattacttttagataaaaggcacttgttacatcagccatttcacatccattgataaagatgggtgcttctgaaatggccacagctgacagccaatacacctgcaggtccaccctctgctggtcattttctgaccacagtaagtgctcagcagccatccccagagcaggggtcagcaaaattctacatcaagggtcaaatagtaaatattttaggctttccaggacctacagttttcctatcaactactcaactctccttttacttgaagcaatagtcaacacatagatgaacgggtgtgactgtgtaccaataaaactttatttacaaaacaacagcaggccccggggccatagtttgctgactgccgccattgtgtagcctgaagtggagctcagaagcaggggctccagccgtgggtggcaaactctcaaacccaatgacaccaacagtatctttggttagagcatttagagttttagccatagttcaattagcagctgatgatttgttcctcgatcagcccaagcatgtgaaacataattgttccttcaattcccatcagccaggaggtgacagggaaatgacctattagctgacttcaggcagcaggaaaagtccaaagttggctgctgccattgccatattgattggtgatccaagagaagtgtggtaactatgaccaagaagaaaaggtctaggggaactattccttatattgtggaaatattccatacttcgctgggatattttcactgaaatcgttttgaactgagaaccagggccattcctctgactgtaaagctttgtagaatatattcaattctgcatgttactgatgggtgctaaccttttgtgtgtgtttgtgtgatgttcgggcttaagggatctctggacaataataatgataattcagctgcctgggatcttgatgaaacccatccactccttcccacctttcccatgtcagatcttctacaaagcaaactgatgctttcagtaaaatattactgatgcaatccaagaaacagaaaaaacagcccaccaatttactcccatttgaacccctgaagcctgttcacagtattaccacattgttattgaagtttacagaacaaaaccatagatggaacccaagaattcttctagttcaagcccattttagagctagattgactgaagtctaaggtgatgtgatctatgtgatttccccactttcaaatatctcctaagaaatggccatagaatgtatgagatttctttttaaaagaactttactcatactgcatacatgcatgtacacacacacatgcatgcacacacaccaaagctcaggatctcctttgaaggagtgtcgagctcacgaatggtaagagcccgtgtggctcaggccctctgcagagccagggcagagagacagatgccattttggggacaatttaggctgcacagctgctctctctgaactgccaacagctgaaccaaaatgctcaggaggtgggctgggcagccctgggctgtgggcacagtgtccttgggtatttacaatccctcgatccttgcctgattggttttccataggcagggcttcgtccaagttcctagggtcgcaataccattctcattagaaggttcctcttgagagacaccatggagcagggaaggtcttgggtgtcctcccatctcatttgcccttcccctaggtgcctgtgtttcccatcccagtggggatccaaagcatgtcctgggcattgggtaagggtttagaaccttgtccccgcctgcatatgatagacatggggagggacaggatcaggaggttgctaggtagagcctgcaggtgcctttccctgaactctgttatgtggctgagttcttcagagaaatagtcaggagctaaggggttaaacaagcatccctccctgcagagacaggcaggtcagaggctgcatctgttaaattagggtccaggccacagaggtaatacctaccactctaaactgttagccttccaatactacactccagttctgggagtgagtaactgtgtgtccagagatagaagccataagcacttgagttacagaactgctgagaaattggtctgatggtctagtagccttgtgccaggagaacagttcctatgtagaaactggtcagcattttcttctgaaaacgtaatcatcattgcagtgagtataaacttccatttatatgccaggaacctataagtttcagaatgtgtctgatccctgaagatgtcccttctctcagacggctggcccttgccccactgttgctgggttgtgtataatctgtatgtccagtcaacctcagctctcagcctctgagcccaggggacagaaggccgtggctttaaatgttcacttaaatattgtcaaggtagtatgtttattgtgtactcccaatggttgtcttagaaaaccaaggatggtgtcatccttagacctaaggggccccaggcctggcagtgccttccttcagagttctaagctccaatgcctgtgtgtggcctggctcacagagccatctgagcaggacccctgagcccagcctgtcttcccctcttggatgttctccaaccctccacccacccgccccatgcatgagtcaaccagatgccctgaggagctctgggacttgcacctacagggtcatcccgaggccctgtggccagataggcaccaatcccaggagagtggggaggtgagctcatctcttttgcaggccggcatggtatttctttggcaggatgctgtgagactgggtcccagaacagtgctggcctgttcattttggatgactcaaattgctttttaaacaggagtcctgaaaaaagtatttggccaggcccagagtactataggggcagccctgaccagggaaacattaatataccctctcccaaaatacaaatctcttttagactgttgccagcagtctcaggaatgatcaatactagtggttgagactagagggaccattaagtaagtggagttgatctttattggatatagctggccctctttggtaagatgtgatcagaagagaaattcaggcagcaggctacataatcttcatagaaagtaaatttcaaatgcatcatacaaaattcacagacaaacacatataattgcttaattgcttccttgtttaataaaatgtctttcctgatcaatacctcttaacaagttgaccaaaccaggtatagtttagcctcctgatcagatttagaccttgaatttaatggaggtatagataggtaggtaggtaggtaggtaggtagatagatagataacccatgaatgttgaagaattgtgtctatattaaaatttagccaaaggagaccagagtaatataataaatttgttcctatgggaaaagcactttaagcaaacatgtgccccattggtgggtggggaggtatatattggtgctattttttgtacagcattacattgtttccctggtggggaagaacaggttagctttataattttgggagagcaatttaatttaaaagatataccctcactgggataattaaatcctgatgtgtgaggttctttcaaatggaagatttgcttaaggtgttcacattttggttattctgaacatttctacttgctgtgttgcggagtcacgatactgaagggcacacatgtttttgtatctcacatatgtgacacatccttatctaaaatttcagagccaagagaaaagaaggaatcagatagtgataacccagtgaggtatctgctgcacagtctgcctctccaactttgctgaggaaactcgaaagtatggaaagccaggagcccggcacaggtcccttcccagcttctgtctcttagcctggcagagacttcagaggaggaactccctgagaatgggaagtcattctctagttgtcttgtgcttcgtgtttgtttttcattgtctttttcaaagtaatgtatgcacaacgtgggtaacactgacttttattggctcatagtgacaaaaacaatagtcccctgcctctctcctcctgaactctggccttgctccccagttgctaatatgttcaatgatttttgctatttcttaccaacaactactttaatatttctccataacatgcttaaatatttgtacttatttgggctgggtacggtggctcatgcctgtaatcccagcactttgggaggccgaggcaggcgaatcacctgaggtcgggagttcgagaccagcctgaccaacatggagaaactccgtctctactaaaaatgcaaaattagctgggcgtggtggcacatgcctgtaatcccaactactcaggagtctgaggcaggagaatggcttgaacccgggaggcagaggttgcggtgagctgagattgcgccattgcactccagcctgggcaacaagagcacaactccatctcaaaaaaaatatatacatatatatgtacatatatatatgtatataaatatatatacatatatatttatactaatttatttagatattatgcattgctttcctactgtaatagatgaagattaactcttccgtattacttttcacccaatttcaccttcccccatactcccatataattatgtttcaattttggttaaaccaatatgagatgattgcattgttgctgaacaagaggtacaatattacgttctctttttgtatacaaagactgttaatttagagacctagagctttcagatcttggaggggttcttctatctcaataactacccaacccccatgttcttttctcagagttcatggaattgaataatttggatggatattctaatttttaaaatttcttttttccatttattttaattctgcattctggggggtttcctaacctttatttttcagcctgtctattggctctaaatttggctaccattcatttaattgctaaggtctcttgtcctgtttcttcctttttttaaaaaaaaaatctcctaaatttctgaatgcaaaacattactatattttgaggctattccgaagaaacagattttgttctttttgaattctttttctctctgcattgtctctattttgtaattttaaatgtttattcatttagtctctgtctttatgaaacaacattcctcaaaggtctggtggtatctgtctgcctcagtagaataataaaagctgaatagaattttgggggctgagagtagagcttgtccactagcaggtgttactgtgattaagcagcgagtcagcttttaaactgaggactctcctatttgatggacttttctctggagccccctcattttcccagggcggaatccctccacctcttgcccagggaacatagctgggctgctgctgctctaggacacgggtcgggaggaggaggctgggaagggtgtctcgctcttccatgcaagcacttgcacactgtcccatcttcaactcagagcctcctcccattccccgctgggactggagtctctgagacctgaataccttaggttcagttcctccagagaatcaacctcccatctcgtgtgttactggaggagggtttttgcccaggtgcctgggctgagggaagggatcagaatacgccttattcagactttcaaccttcctgcatattcacttgctcacctggtttctgcccttccccgcacccgggccctcccatccccgagcccctgctccgtggttcctggcacctctcttggcctcttcttggcgttcatcctcgccaggtacttcggttcctgtttcttcagttccaccaaaccagccagtgttctcccacccatggtctgtctttgattacaggtgttgaaatgttaggtctgatctgctgttctctcttctcactcctcttcctgtggatttttaccttttttttcatttagtgttattttggtggattttcagcagtaaagaggaaataaatacatattaaatccagaagaatccagaatgtttaaatggaagtctttgatcctgtctgcttttattcagatcaaatggatcagatgacttaaatcaaaaggtaatatttatgagacacaaagaattactctctcctctcaacaaaaataaagcctccgcctctaacatcatccagtctgcctcccagacatgaacttgcgcacaaagatgtcagggagccatcaggcacggcactgcctaaaaagcccatgtggcataaagaatgagcaaagcgctacaaatacagggtccttctatacaggttattcacactgatcttcccaacagcactattagttggtaatatgtctatattgcagattaaaaaacatcagatggccagtcgcagtgtctcacacctgtaatcccagcactttggaaggccaaggcaggaagatttcttcagcccaggagttccagcccagcctgggcaacatagggagatctcgtctctaccaaaaatcagaaagttagctgggtatggtggcacatgcctttagtacccccctacttgggaggctgaggtggaggatcccttgatcccagcagggtcaaggcggcagtgagccctgatcataccactgcactccagcctggccaacagagcaagatcctgtctcaaaaataaaaataaaaataaaataaaatacatcagacatagagcggttaattggctacccaatccagaacaccaagtagcaaagacaggacttgaacccgggacctccaggtgtttctgggtgttctttgagttcctccatcctgaatcaatagtcaagcatcatgtataaatggagccacagtcctcaaggataaacactaactgcttgtaggccactgcaggccattcagtacagtgttttattgtgctgcaaagtcacctgtttccacaagtgcttccccaatgcaggctttctaaagtcatcatggaaagtaaattattttcccctaacaaactatgctaaaatgggcaggatgagcaggaagtgcttgtgtggtctacattgtatacaactatcacggaaagttcaactcatgggacacttgggttatctggaggacacatggccgtgagaggatgtggcgcttagaagctcccttcatcacttggttggccctcattcatgcatgctgaggagggggtgggaaaagttatagaagccagtagccaaacccggtatacccaaatgtttagcttagattgaagctttggtgtttctaatatgtacattcggctcacttccagaagacagagatgggggacttgaaaactagcttagcagagagttagttaatcctaaacctacctcgttctgtcaccttggcgatgaaatgactatcctaatacagtcagaagaggacttaataatcagccaggcaggtgcggggagggaatgccagaaacatgcaaaaccgccgacagcaagaagtttccattcttttgggggtgactgtgcataattaagtgcctacaattcccaaattaaaaataccagttcctttacaaccagcagtggcaggtctactcaggggcagtcaggaggctcccacaagtgcagctgtccagcactgcaccacacctttctcttttctccaaaagaaatagttttatataatagatatatccaaaaatgtagaggtcataaaaacaacagcagataaagctgtatccttgttggttttatttgtttgcttttggtgttatgtttagggtaacatgattgctgctgataagaacacattacctttgtaaacccagcactttgggaggctgaggcaggtggatcacgtgaggtcaggagtttgagaccagcctggccaacatggtgaaaccctgtctctactaaaaatacaaaaattagctgggcatggtggctcatgcctgtaatcccagctacttgggaggctgaggtgggagaatcgcttgaacccaggaggcagaggttgcagtgagccgagatcataccatcgcaccccagcctgggtgacaagagtgaaactccatctcaaaaacaaaacaaaacaaaaaaacacctgtgtagagcaagttcaccttttcatagcacatgcagaaagcacacctctgtgagtttgcaaagagaacagccctcttctgctgtgtgacatttcagaagatggaggctcagaagcttcaagtcttattttgctaccaggacagaaacagaagccaaatctttaggcttcagatttacctttttttcctaagagtgggacatcatatttaattttccaggtcaaagaccagcgcttgagttgatcatagatcttctcagagaagtcatctgaaagggaagtagtctgttttcttagtcacctgaaaagccatagaataagataaggcttagaataagaaaatattggtttctccatgagaagaaggaagagaaaaccaagttgaaccatttaagtctcagttgagttgaaatactcaagtgacaaaataatctgaaaattaaaagtatggtgtatctctaaacaattattttagcaaacatactctggttaaaaatgtattctaaagaaggttttatttaattataaatatctatattttgtttttcacctcttccaaaagggtagaataaagtaggaaaatgcacttgggttcatctcgaaactcagaggcagcgtggtgtggggcagagggctagcatgggaggtgggaggcctggtgttggcccgggaacccgcactgaccagcctgtggccagggcctcatctgagtggagggaggccttggtctagaactgagattcaccatacaagctccccagtctgcttgtggaccaggagtgtcttgggaatgggaaccaaactaatccaaagatgaagttcaactctttggttcttatgaagtgaataacccacaatgccatagacattcatttttctatacacttaagggttacaaaaggagttattaaatgtgaataacgtcttgaatatataaaattagactgcagctacagatttcccaggatccattccatattccctggaatccagcttgctccaagagcctggcacactctggagcttttgcttcacccagcaggtacggagtcaaactcgacacctggaatctgtatgttgctagtgttgagtggaactcaacacctggaatctgcattgctaacattgagtggaatttaacacctggaatctgtgtgttgctagtgttgagtggaactcaacacctgggatctgcattgctaacactgagtggaatttaacacctggaatctgtgcattgctagcattgagtcaaacttgacacctggaatctgatcattgctggtgttgagtggaactctgcacctggagtctgactagcattgagtggaacttgctagtgttgtgtggaacttgacacccagaatgcatgcattgctagtgctgtaaggaacttgacacccagaatgtatgccttgctagcattgagtggaacttaacaccagaatctgtgcatcgctagggtcgagtggaagtctacacttggaatctgcattgctagcattgagtcaaacttgacacctggaatctgatcattgctagtgttgagtggaactctatacctggagtctgactagtgttgaatggaacttgctagtgttgtatggaacttgacacccagaatttatgcgttgctagtgttgagtggaactctacacctggagtctgactagcgttgagtggaacttgctagtgttgaatggaacttgacatccagaatttatgcgttgctagtgttgagtagaactcaacacccagactctgtgtgttgctagtgttgagtcgagctggacacctggaatctgtgcgttgctcatgtttggggtttgtacttcagttattttacttgctcatggctttttgttgtaattgttttttgtttcttttttatttaaaaatcatcctttaattatctttagtatcttcagtttcattcactggcttaaccagatagtcgacaattatgtgttagacatatctgttctgaaaaatatttttagccctcaaattttttcaaaactaatttgcaagatgtatacgcactgtagttcaaatgtaaatcatcagtgtcctgattactgaggcagatgtatcaataagatcgccagatttgctagtgcaatgatgcttccttatacagcaaattatttttcctatggggatggtggggagatggatttggaggtgatttatcctgtaagagcaggtttggaaagttaattagcctctggagaaggttccaggatctctggggctgggtggagctataggggtgggaagcacctgggccactactgtgcaggtgtgtgcagtgaggatggctccctgtgcttggcccctctcactacagggcacgccttcttcctgccagctgtcctcagagacaagagtctcactcagcttcagctcaggcccgctctctactgagccttccacctggacttccaagtggaaacaccccaaagatcctcatccctttcctccactcgatgcctggtttggctaccacccataagtgtggtgttctgcctggccccgccaaacctcttccaggcacccaaggtctggcctctgctcaggttcaggtcttgggccatcgtgtattttccttctcagaataggtgcctgggttgttctgactatggtctaagagtcttccctgccctgccctgccctgccctgacctgctgtcccctccccttccctcccctcccctcccctcgcctccttctctttccctctctcccccgctccttccctccttcctccaggaattaagacattgaacattctgtctcatttccatgatttttcaaacagtgccaaaagagccagcaaatgactgtgcgattatctccaccaacctatttaaaacattgtcgttgtgtttgacttgatgtggtccttcatcttgaccatgatgtttgttttactgcttccttgatgtataatttacataccataaaatctacccttttaaagggtatgattagatggtttttagtattttcagagaattgtggaaccatcacccccagtctaattttagaatattttcatcatccaaaatagaaatccaatatccattagcagtcacttcccattcatccttcccctagccttcagcagcctctactctgctttctgtctctgtggatttgcctactctggccgtgtcatataaatggagtcatttggacttttgtgaatggcttctttcatggaggatactgttttcaagattcatctgtgttacagaatgtatctaaactccattcctttttatggccaataatattccactgtatgcacctgtcacactgttcatccatccatcagttgctggacacttcctggctggttttcactattcagctggtatgaatgaggctgctatgaactgttatgctcaagtttttatgtggatataactgttagatttataatcattctaattagccattttgtacttttttttaaagttttttttcttttattatactttaagttttagggtacatgtgcacattgtgcaggttagttacatatgtatacatgtgccatgctggtgcgctgcacccactaactcgtcatctagcattaggtatatctcccaatactatccctcccccctccccccaacccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatgaccgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacctagtaatgggatggctgggtcaaatggtatttctagttctagatccctgaggaatcgccacactgacttccacaatggttgaactagtttacagtcccaccaacagtgtaaaagtgttcctatttctccacatcctctccatcacctgttgtttcctgactttttaatgactgccattctaactgatgtgagatggtatctcattgtggttttgatttgcatttctctgatggccagtgatgatgagcattttttcatgtgatttttggctgcataaatgtcttcttttgagaagtatctgttcatgtcctttgcctgaaactgggtattttattcctcagaaagaaagaggagactcgaacttctaaacataaattgtgtttgaaaatattggagcttacttatcctaccataaaacactcagtttaaaatgagcagttttaagatacttggttttgttccaactaatacctctcctgcctttttttggtcaatttatttttgttattaaaatttcttctgccgttggcacccccagaacaatatattcttcaatagtttaaaggagctgcttcctcactgggatgtggacccttcttccttcttttaattacagcgttattaaactcctccaggttgacactttctttcattctctattttagatttgtcaatcagaggtgctccatgaagcagctccttagtgctgggggaaatgcaaagccatggcgtgtcactgtgggtgcaaacctgcttctggagctgtgacgttcttggggagggagggctgtgaagggtcatcttggaggggccacccctgcatctcacccgtgagccatccttctcagaggatgagagagtggataagagctcaggagctgcaagggagcattgcgggagcactgtgcatcataagaggggaggatgaaaccgacaaagacgggcacctggcagggagtgctagtaaactgaggcgtggactacagaaacaatcctcccccgaagaacttttgaaaatattgtacagacccagggcaccctccctgacctacagaagccaaaaccccagtgtgggagcacagtatgtacgtttagaaaagttttcatatggccgggctcagtggctcatgctgtaatcccggcaatttgggaggctgaggcaggtggatcacctgaggtcaggagttcaagaccagcctggccaacatggcgaaaccctgtctctactaaaaatacaaaaattagccaggcatggtggctggtgcctgtaatcccagctacttgggaggctgaggcagaagaattgtttgaacccaggaggcggaggttgcagtgagctgagattgcatcactacactctagcctgagcgacagagtgagattccatcttaaaaaaataaaaaggcagaggttgcagtgaaccgagatcacaccactgcactccagcctgggtgactgtctcaaaaaacaaaacaaaacaatacaaaaattgtaagtatgtgtggggctcatgtgctgagtttggtgggggaaatctttccatgcacccccacaactgtctacaatatgaaaacaatcttcaagaaaacaccagcgaacagaccattcgtctttccctgttgccacattttatcttggtctcaggctgctgacctgtcagatgattgacaaatggaaaccgtatggtggctcagagggaccaggcgtggtgtgtgctgcattgaggagagggtgggtaggcaaatagaagttaagcaccctaacagaaatcattctaggcttcagagcttagccagtagcttagcaagtggtattttctaggaagccactcagattagtgccaaccttctgcagaaatacagagctataggtgctgggtgagttgtgagcaaagccatgttcagaatatgttaagtttctattttttaagtgagcttatttgctgaggtaatgcagtttgcctgaggcaaatgatcatttagatcagctttcatcttttaagccagatcttgagatttgaggcgctaaactctttgcgtacgcattttacagctctcttacttggttgggatccactgcttcccagtatctgcagacccttctggggactgtgacctgcagggggttaggtagctgttttcaggggggcattttgagcccgacattcacgttttataacattagctgtgtgggggctggcaagaagaatctagccttttccattaatttagtgactttgttcattttaattttttagttaattcactgactttataattttgctaaaccctacaaactgctcagcataaatgatttcctttaatccctacaaaatgtcaggctcccaggcctgcaggctcagagtgtatgcagggcgaatgctgcttgtgtcttatccaggacagactggcctgtctcgcacctgtcaggcaactttactcctgatgctgctttctgggacgccatccaatctcatttggaggttttgtcagtgagcagatctgtttctgttagattcaattgaggcagaggcagacactgaggacagatgggtggctgaagataacaccggggaaaccagcctctaagaaatagagccactgcaattaagacttccactctctctccagaggttgtggagtcaacagaaaagcagatccatgtctgaagaccatgacaccttagaagcccagacagacgagagggaaaacagcctagaagaccttgccttattatttctactctagaaagatgcacgggatcaataaagtaaatgagctgtttcatccaagctggccgcgcagatccagggccacagagacagacagacacataaacgcattgatcaccctgctagggcctactggcctaccctgcatggaaaatgtgaatggaaagaaggcaaggaaaatacactatttgtagttctgagccacagctctgattgtaggtcacctcctttcctctgtggaagggcagtcacattgtgatctttcaaaacattggctaaggcggtgatgataaccaaggctgatatgttaccagcacacagcagatctcagggctgagagtgaggcatgaatcttccaagtaagtggctccatatgggcctctttgaggtctttaaagtcaacagtctcttcatcatggaattcaacttgacccctgttccaccgacatcagaactggtgaggtgacagggatttagagcgacttgtcaaagggatgggaaatgcatttgctcaaatgataatgacattcacaatagtcaagattcgttgagctaggatgcatgctaagaactttacaagcatttctattaaaatctcaacactgctcaatgaaatatgtattatcgtctccatttttagataagagaattaatgtttagaaaggcaagttgatcaggcatatctgtgcagcaaatggtaagactcgacttgaactaaccttagacaaaaaaacaaaaaacaaagcaaagctgtggagtggcaagagcaaggctggccttagggacagcgggatgggggctcaggtgcagctgagaccctacccataccccttctgattgcgctgctggcttctccacttagggaatgagaggagacaatcagttgctattctgagtcatttcctgggtctctgagtaaaaaggagagaagcttcctctcttccagcttcagtttgaagagtctcaggcaagaacccggttggcctggtagagtcttatgcccatccttgaagcaatccctgaagctggaggatacagtcctaagggtcctaagttactgggtgccatatggtggtgggcggggtggggtccatcaccaaaatggagcacagagggagctagtatgaatcaggcaagcagttggctccacttccacatgagatggcagcaggcatcgctaagcctgattcacagcacctgggcttaagttgcagcaccgatacataccagctatgggactttagagagggcattttctctgtgtcttgatttccttcattttaaactgaggacaatcatatctaactcctgtgataattgggtgtgttaaatgaattaatgcattagaggagtatctaatacaaggtagatgcttcattaatgtaagctaatgttatttttaccattacttttactgttattataaggagctatgtatcttgtccaaggtcctgtaatagctaataagtaaaagagccaaaattattattattatttgagatggagtctcactctgtcacccaggctggagtacagtggcgagatcttggctcaccccaacctctgcctcccgggttcaagtgattttcctgcctcagcctcccaagtagctgagactataggcacgcgctatcatgcctggctaattttttagtagagatagggtttcaccatgttggccaggctggtcttgaactcgtgacctcaggtgatccacccacctcggcctcccaaagtgctgggattacaggcatgagccactgcgcttggccccaaaattcttatcagagttacagtgggagatatcacaccatgagctctccttctaaggatgcccaggccctgaattctggcacctacctcgcctgcattttgtaggttgcactgatttgcttagtggggccacagtcaacaggctctgatcaaagccacccttgccgcagctgacccagcagcctgcccagctccatccagggctgttagcccatcctaaaaaggccctctccttatagaccattgcccgaggaggtctttccaggccctacctcctgaaactcctctctggcctagtctaatatcccttatccttcctaactttcctaagtttccagtcctaacttccctctccacctgcaccttggacatgatgattgacactgtgacttgcttctcaaaatcagctcccctatcaggtctgttttgttctccgtcctgaagacagtggtcacgacctcgcccaaccctgggctggggctcagcctcctgctcattacaggggcagacgtgccctttgatgtcaggcctgaatagaggttccttatttattacaatttattatcctccgaatctgcctggggttttgatagaacctggctgccaacggcttgccctggcctttctgaaacctcaccatttccacaatgaaacaggacgcaaggactgtgcccctggtatgggaagggaaggaggagaagcttgcgtttacaagtgagatatccacagacagggaacatactacatttttttcttctagactagcctctgtggactagttcatcctccataaggttgatatttttttcccaaagcctggatttgcattgcctagagccacattcacggtaggagatgggtcttcccagtgtgactggactcacttcttagcactccctcggtgggtgagttaggctggaatgaagggaggagccacctttgggattgcggtgctgccctgggcacctcacactgccttctcttcctgctgctcgctggtgcatgcttagaaaacccagtcagcttgttttgacctaaagcaaaaaccattattctctgagtttgtaggtaagcttccacccaaaatattgttgtgagaccttggatttggtgatcttgggctagctgcctaacttctttgggcttccatttctgctctatcaggtaaaggattgggacagatgatcttttatggctataaacatccagtgtgctccaaggccactgccaaatatacgcttcaacaacgctaggagtggtttgcatgatctcctaggcttgggaactctgggagcagggattgtctgttctgtgcctggtacatgggggtcatttaatacacgtctcgacaactgcatagcccttttgctccctgagctgagaggacagaggaggatgttaacagtcactgtctcaaaaagccctgagcaaatctgctctgttctcagcacctctcagcactgcctccttcatgagtccctgctgggtgggtagggggctaattaagcttgagtttcaagaacttgtctacaaatccacttcaagggctcacatgcaaatcaggccctgctggcagccattaccatctcccacctgcagcccaggccttagaggccaggattcacaagcagaacaacacctgccctcctctgagagctgtgctgcagcccagggccacgtggacagggtgctggtgcattctccagcaacactgttgagctctctagtttgcagaagagtccaagggtcctcacaaaacctgtgacaactgaacaatcccaccattcttatatgatatatataaccaccattccatatgtataattatgattgaaaccgaatatcattcctgattgcagagtctccaagatggtaatttctgtcttagtgtattttccactggtagttttgtttgttttcctgactaacgttatgaaacagtattactctcctgttacagatgtacacactgggatgcagagaggtgatctgacacaaggacagcccatggtcaagcccctttgacttctgtctgctgttgaaaaggatgtgcctccctttcactgagcctcattgcaatacttgtatagattctgtgcccctccctcccttccttccttcttccctgcctgcctgcctgccacaggtgtttaatgaacatcaactatgtgccaggggctgtggagtattctagaaatgaaacaaggttcctgctctgagtttttatgttgacgagaaggaaagggtgaataaacaaatacattaacaagaaaatatcaaggagcgataagagccctgataattatttaagatgagactcaggaggcaaatgtgacttgagcagcctgccccgcctcctgtgtgaagaaaggcaggaaaacattccagcaagagagaatccccactgttagaatctctgcatgttgtcattagctgcatagatctgcttgttgaaacatgaaccaaaactttcaatcttggtctgcttgccctggataaagtgcatttctgagtcttggaccacagcttgggaaattagcagaggcaaatgcaattgtctcttctaaagtctttttttttctttttttttttttttgagacagggtcttgctgtgacccaggatggactgcagtggtgccatcacagctcactgcaacctccgcctcctgggggcaagtgatcctcccacttcagcctcccgagtagctgggactacaggtgcccaccatacgcttggctaaattttgtatttttttgtagaaagggggttttgccatgttggccaggctggtcttgaacttgtgagttcaagccatccaactgcctcagcctcccaaattgctgggattacaagtatgagccactgcgcctggccctctcccagtcttgagaccacagtggttggaagctttaacagaaaacattatatgtgtgtcttcctcaggaaatgtattttgttaaaaatctgtaacatgaagggaatggtaggaaagagtaggctgcttttgcatttaaaacaatgttaggagtgaatcgctttcctggtgggttatgttagaatgaatctcaaaccctcactaatatctttcagaggaattttggcaaatagcagttgtttcttggcctaattgaagtcttggttaatttatcccaataacaataacattaccagtatttgtataacaaaaatggtttctgactgtgccagcgtgggacgaatgagactcatcacaatttgttttagggatggagatttagaagaatgggtggagaacattctaaatggaatctatggacagggtttttattcttagtgaattttgaagaagtgacgtaaaggaaacagtttcgtgtaagccctggctcctccctcaggggcagctggacaagtcgagcagatcctggaagtaaaaggcagccccggatttttatttctgttttccctttcaccctaacaaggccgtgctctcctgctcatctctctccactgcctggactcctctctctctgccttctctctctgtttcctcccccttctctgtgtgcttccacctcccgctgctccctgctctccctgtctccgttccccatcccttcttgctctttgctgctgaccagctgtgcaactctgtgcatctgagggactcctctggacgtcagctgccacatctgtgttattgaaggggacagacacgggattcctattatggccaacgcagactcaccctttctgcaggctcaccaaggaacgaccactcagggagagtgggtctgacatcctgagaatcaccatgacttccccaaaccagtgggacatccggggcctttgactgtggctgggctgcctctgacgggcgggaccctgacacccaccttagctgtgacagttgctccatgcagctagttcctgggcacctgtgcagttccttccacaggaggacattctgccctttgccttctttgagacatgggtgtcttgcttaaggggaccagtttcccccacgtgcctctctaccatcctttggctatagggtattttaaacatacagatttattttccttttctatttacagtttcctttgggtgagaacggagtgagttggttatgaccgggggacctgagtcacaccactttgattaatgccagctccaccacgcactagctgcatgactttggacaaatttcttactttcttgcagttctgtttacccattggaaaactgaaataataaaaagaacaaccttacgtggttggggagaagtagatacacggattcattacagtgcatggcacattttatttttatcttggttaaaaaatgcatagcatagaatttaccatgttaactgttttcaaatgttcagttcagtagtgtgaagtagatccacacagctggaaaccagatctccagtgcacggcacatttttatgctggaaatacctctgttagaaataaatccttggaattgatacatacacaaagccgtcactcatcacaaatgatggaactagaaagccaaggcctattggtgtctaagagtcagcctgcccatgctcacagacctgcctggaaaggttttgttttgtttagaattttctttttatcaccatttcttcattactggaagcctggctctttgcagacaaatcgatatctccaaggttaaacaatttatttttgtatatttttcaggagacatcgagtccctgtaatgcaagcaagttgctcatttcctgcttctccagttctgtcttccttgtcccctcttcccctgcctctctcctctcttctcttaccctctttgttatctcatcataatttcttcacagcccaatttctttctttctttctttttttttttgttttgagatggagtctcactctgtcacccaggctggagtacagtggcatgatctcggatcactgcaacctccgcctcccaggttcaagcaattctgcctcagcctcccgagtagctgggattgcaggcccctgcaacacgcgccccccacccctgtctaatttttgtatttttatttatttttaatattatattctatggagtcatttcccaactagcatgtcttatgcttgaattattctttatacttaatactgcccatcacataaaagacgttgtcacgaacccagtgttgttggcagaattttggctcctatgatctctgtcacctggtgtcacaccaatgggtatattacagtacctggcaaaagagactttgcagatggaattaaggttggaaatcgtcttggattctctaggtgggaccagtgtcatgatatgagcccttcaaagcaacagacgaggtcaaagcaagggaaggactcagtgtgcaactggtggcttaagggaggagaaggcctgagaaggggctggaccctggcaccagcatgagctcggaagcaggttttccccccaccccacccccagagcctccaggaagaagtgcagcactgctgaaactttgatctgcaccgccccactcccaggccctggacagaaaatacagccactctatgctggacctgggacctatagaactatagtgggtgttgccttaagatgctcagcttgcagcaatttgttttggccgcaacagagcactcctacacctaccattcactggcagataagagcttagaagcaaggctatttattcttactggagactggcttttttttttttttttgaggcggagtctcggtctgtcgcccaggctggagtgcagtggcacgatctcggctcactacaacctcagcctccagggtagctgggattacaggtgtccatcaccacacctgtctaacttttgtatttttagtagagacggagtttcgtcatcttggccaggctggtctcaaactcctgacctcaagtgacccacccacctcggcctcccaaagttctgggattacaggcatgagccaccatgcccagccagaggctggcttttttttgcttcaaatgctttatgaccaaaactgtctatgtgcagggtccccagctgaagtggatacatattttgtgttcatggaataggaggaaattagttggcctttcagaaatatgggacaagatttcttcttagaaatgtgccctaagcaagtgaattgagtaaaagtgtggattctgagtccctgctccttgcagaggactatctggaaatcggttgcattctcaggaaaataattcagaagtgcagtatcctgtggaccactgcatatttcctgaatcagtatctttgtggatatgggaaggggatgtatgtatatgtttggtgagcgcccaggcagtacatacaaacatttgaaacccactgctgtgctccagtgttttttaaacagctggttgagacccattgaatcatgaaatcagtgtagccagaccatcgtttaaaaaaattagaagtgcataggaaagaaaaggtaatgttatcagaatgtcttgcaacatggtaaggacaagtgtgtttggtgaaacttttgtttcaatgtgtgtgttttcactatatgtgtctgcgtatgtgtgtgtccagagtcaccatgtaaaatgagcaggaatatttcagaagcactgctcttgtctgatcttgcaaatctcaagcctttgtcctggactctccaatgcgctgggtctctgatcaaccctgccctgaccacctgcgtggcctgccttgccttatggcgaccctcggaagagtcgagcaggcagcgcgtgcctggggctttcagggacacacttccttccattcggggacctgtgagtatgtcagtggaaatcatttttttttctttttctttttttattttttgagacagggcctcagtctgtcgcccaggttacagtgtgatcctggctcactgcagtcttcatcttctgggctcaagccatcttcccacctcagcctcccaagtagctaggattacaggcacacaccaccacacctggctaacttttgtattttttgtagagatggagtctcgtcatgttgcccaggctggtcttgaactcctgggctcaagcgattctcccaactctcccttccaaagtgctgggtttacaggcatgagtcactgcacccagccaaaataattttctattcgctggggagtaaagttgtctttgcatctcccgcacagatatacacaagaaatataggcaggtgctggctacggatgcatagaaatggatggcttcaatacaaggtttttggttgatgtggaacaatattaccgcatagataaagaagccccttcaaaattagctttaccaatgagatatggtaaaaaaaagaagtataagtgatgaaaactaaagagacatatgactgtaagtgttaagacttgaaggaaataataaaagccaaactgcatctctgattttaaaatatgggagtcataataaatcaacagaaaggataaaggtatgctgaggaaagccaaagaggagtgaccactgttggtcaccaaactgctggctatttgcagaagggcctgaggccctgacctgagacttgtgctcaagtcagcatagtttgggctcattggaatatgtgatgctaacgatgtcccccagaagagtattttgttcctttacgcactttttaaaataatcatctgtgatatgaaaatttggactggtcttgaaggaatgagtcctctccttacccaggtttctttgtgatgtcaggcaatgatggtaataagaatggtactccagtactaggagtaatacggtactttgatagcgcactaatgcacagcattggcagaaggctcatggtggatgtgaaattaaacgcttcgtataacccataggcgatgttgttgtctttgtcatggacaggggagaaacatgaggcccagagaggtaaggtgagcactccctaatagtcagcattgggtgaggcaggaacattgtggccctgagtccctgagattcagggcttttcccatgaagccaacccactggtcactgagtggtttcactcctttcaccaaccaggatacttcagaaagcacttggggtgacccaaagctgggtccagatcaggggagtcggttgtaagttgtcatgacacttcatccttacagaaggtggaagttactcatttctgttcaatgagctttgaagaacaaaaggtcactgctaatttgaagattaaacctttataccaacaacatcctccaattactatagaaaatttagcatccaccatttgctcaggaagcaaagaagtcactgttgaacaaactctgaaataaccaaggcctccaggccccacacctcttttaaagtgctttcatgctgaccatctttttttttttttccttctatcttcagcccctaaccacaaagccaaaaaccacaagaaggcagaaaagtacaataaatgggttttctctacccatccccagcaattgtttcacagttttattaagttggggattcttggaaaaaaaaatcctgaaaaaaaaaaaacaattctagtttaggatccctctttgagtgctctgcaacataggcgagagcagtaaaaacacgttccattgaacacagagcctcagacatagacatctgtctgttggaaggaagtcactgactatggctttatgctgaaatacacagatcacgtttatataggattttatcatttgaaaacatccctgctcagagatgatcctgcctcattctgcaacagccttttgcagtttacatggaaggattcagattaggagggagaagttgaagagcctttagactagaggcagcaggaggaggaacagcctcagatgggggagagaggagaagttggcatgtccaccactagcaaagatctgggtgctgcttcaagatagaacccaagggaagtggcagggtcccaaggggaatgttgagtgaggctctcactgggggaggtcccagattcctggcccccagcccctccaaagggttatgagtcccaggatggcccagaagcaacagggctgacacaccttaaggagcaatgcaggctgaagaagttcctgccactggtgactcatcatcagaattcccctttccctgggctgtggctctgcataaactcacaggactgcagaccaggcctggaggagatgaccccagagaggaggaagactgagtgtgctgccagcctattagaactcagcattgcattcaaattctagttgctctaaagaaaattaggaaatgtgatatttcttgcacacctgaatttgtaggctacatgcagaacaaaggacaaaatgagagtccaagaaggaagtgcagtgctttaagggttgagtgaatggagactgaagggtatttaacgggccattggcatcaaattagaaagtatgggtcttagaatttcttttacattagaagactttgggctgaatattgatattctagggataaattcttgataccctaaaattcagccctcatacaaagcagtgattgtgatttcatgaatgttgtccctgagaaacaagtgtctggcatgagctccccatgtctggaccaccaagctgataccaataatggctgttgcttccttttcccctacatcaaaaccttaggtttgcttcaggcttatggccttggtcatcctaggagtcaccaacttgctatgagaagctggcctgattttgtgtcactttcatctttgtaaagtataaacacaacatgtgaagttgttaattttcagtgcactgccccattctgtagcgttctactttgtaaatgacattgagcatatacactttccaccattgtagtaagcccaacattcagtgaagacagatgcctccatttatttaaaaaaaatcaacacattattaattttaatgcaatttaagctaaaaatgaccgacaattcttggtttaccaacaacctcttttaaaaattgagactctcataagaggatttcggtttaaaaatgttgaaaggtctttttgtatagaaacagaatgaagtacaggatatatttaaaatgtggctaattaacaaaatatttgtggtggctcatgcctgtgatctaagcactttgagaagctgaggcaagtggatcacctgaagccaggagttcaagaccagcctggcaaacatggtgaaacctcgtctctactaaaaacacaaaaattagccaggcatggtagtgcgcacctataatctcagctactcgggaggctgaggcataagaatcgcatgaacccgggaggtggaggctgcagtgagctgagattgcaccactgcactccagcctgggcaacaacccgggagacagatagatagatagatagattctctctctcaaaatatatatataaatatatatatatgtataaatatatatatctatatataatatataatatatatacacatttatatattatatatagatatatatttatataatgttatataaatagatatagatatataaataaatatatataaatatatagagagtatatatatgtttacgtatatatttagagagaatatatatatatattcgagtttatattattatttttaagatttcaaaagccttcccttaaacacttagatccatgaatatcccgtttttttactaatgtgggcgatgaaacttcaaatgacttgggaaaagatattctaggaatgacaatctttttttaaaaaaattcttgctaggaagaagtatcagaaacctccatgttcttacccatattttcagtgattaacagtttcttgtgatgcaagttttctccacagtttgtttccagggttacaaatccatcatgcctaccttttcaaaatcacattaattcaagttcacattatttttatcagccatcaattaaatattaatcagcttttcttggtctttagcctataggtcttacttacaagactctttaaagaggaaatactagaaaccctgccagttcaatcccctggcttggaataattttgtcagcagtactgactcctgtagctatctgtgttgcttaacttgcgacttctcttaagtggaaagttgaagagctttaagagtattaacttgctttgtttccatattgacatgatcaacaggctacccacagatctgatgcatttcaatgcccaaacacaagagcatgcccctggaaaactgctgattctgagttccagtaaagctttaagctcctgagattatgaccatttctttattttggttttccactcgtagaaactgtctttcagataagagaggaacactactgtccagagagtggtgacaaggcatcatgggagaggtgcttaaaagtctccccaaccgccccatcatacttccttgcaagagccagctctggtgtcagaaattccctagtgttctgctggtttatgtaagacatgaccctctccaatgtgaatgcctctgtagagagagccaactgatgacggccttaaataaagatcctgaaactcctgtcctcttcattcagccagagaggagctgagctcacagccctaaactattcatttctaccaatggcagaaagtgtatagcccatttttatatgtttaatatgtaaggcagcataatattagtttatacacactcatttggaccccttatctctctgtgtgtgtttaatttgtttcttttgccattttaaaaacacttgaggtgtggtgcactcatgaaaatgcatctccctctttttttttttttttttttgagacaaagtctctgtcacccaggctggagtggttcagtggtgcaatcttggctcactgaaacctccgcctccctgttcaagtgattctcctgcctcagcctcatgagtagctgggattacaagcatgtgccaccacacccagctaatttttttatttttagtagagacggggtttggtttcaccatgttgatcaggctggtctcgaactcctgacctcatgatctgcctgctttggcatcccaaagtgctgagattacaggtgtgtgccaccgtgcctggccgaaaatgcatctcttaatggtcttgaggactgagccccatggctggcagtctgggctgtggatgtgtgatcctgcttgggtttaggaggatgaacaagctgaacttctcacttaggaaattgcaaaataccattgcacactgaaacctgtaaatttattttggaataattatggattgctaagggggacagaaattaaggccataactctacaaattgtaaccaccaggattgcctaggtaacagctccaagatctccagggctccaagaagaagcgtttatttctcagtcttgccacatgcccattgctgacctaccagggggctctgctgtccccctcctcatgctggttgccatgccagaggaaagagagctctggaaggttttatgtcggggctgttcaagctgctcatgccaaagggatgctgcttccttctagaacctgttgacaggtcacccagttccttctggccatagcaaccaggaaggataatgtaacatgtgcccgggggaggtgggctggaaatgtttggcagccagcactgctcacacacagatgtcaagagatgattttcactggacagaaaagccagcagcctttccggaggtgaagtatcctccgtcttcatgactaggaagaggctttgtgctgtgtctctcggtgtgctattaatatgtgagccagtgcattgccctaaccatcaactccatcctgcttcctcatcaagagaaaaatgcaaaaccacctgctgtgggatggagaagaccagcgcattcccgaggaggcactgctttcccttgccctcacagcctggcctttgaatattctcccagaaataggttcttggttctcattctcctttcctgagccctcctttctcacttctcttcccactctgtgccctggagtgccttcctgtaattcagagctggtgttcttttgggggatttctcttcatgattgagatgagactgtctaaggggctaatgtcacccatttcagaattcacttcccggataaggattcttcatagctgtgttaagattttgctgttgttgagtccccagctggctagtgctcttggcctccatcacttttctcttcctcctttcttgccccctttggtttcatgaagctgattttttctcaagtttcgactcttgcctctgagccaccttttcagtgcatgactttcactgccctaaaataacctatagcaagaaaatcccaaaagaacagtgttcattcactgcttctaagtgacaatcagaacttcttttaaagacagcatattattataattcattacaatgaaaaacagaaggtgcctgggtgagttgaagtaattgtttagttgtggctcctgatctttttaaaaggtctgcatgtgaactaaacactctaaatatgtccagtccctcctgtcaaattcctgtaagggcagaatcacctcggggagtggttcttccggagtggtgattgacatgcaaaatgctgcgcagagagcctcagcattcactagggcgtcttccttcctcccctcctcctttccttcctccatgactgaaggcttgcgtggttcccacaccctgctgggcactgatcaggttctaagatctgccttcaaggaacccacagcctcatggagagaacgacggacaattaggtcaccacaacaccggatagaaaccccacaggcgcagtcagtgcctgcctggctcacactttcataccctagagccaggactccaaaaccatgtgtccaatgaatcactcagcaccgggactgtcacaaaagtgagtgtaaagaactgtgggtcattccctctgcatcgtgcatttctctgacaggggccctgcactatttgcggaggcatctgtagatttatttcttaattgcctaaaccactctgaaatacctgtccattcccttagcataagattaagtggataatggccaaatctctatttttctgagtagccaaacttagcggtcagcatttagcctttatccacaaacatggataggaagccctgcccctgggcatggcagacgggcaggaccaaccaagaagcagggaccagcccaggcacagtgaggaccctcagcatcaggcaatgattttgagttgagataatggttagtgtctgtgtttctcagagcaggatatgctctttaatctaggatgcaaagcccatatgaggtaagaaaaagaatgtagaaccatttggaaaacacccatttttcccctgggaggctgagtaggtcagggggatccgctggcagggggtcctctccactcccctctgattcccagaggccgagaatgtcgtgttcagccattggttactctgtgctgcacggtgaagtctgtggttgttggtaagcagcgtaaaagccagggagtgtctgctgcaagaatccctgggcatcacgttgcttccgacactggtctgtgtgagtcccacagacgtcctagcagctgcaaggggcacacacctccgacctccgaccggcaggtatgaatgcttccaaagtgcccggagtgaacagattaaagcaattttggagggtgagtaaaaggatacaaatcaacttactgaacaaaaagaaaaagtttaatttctggaaaaaaaaaaaaaagtagctgacctgcagtctgagatatgctgagagatacacacattatcttacaaaatttctgcggggaggttcagtcgtgcctgtttgatgccttactaaatgttgggaatctaattttaactgatctgcagcagaagcaatcagcagccagctctgtgttgggtgtttactcagagcaaaagttttctgggaaaggcagtttagcatctgagccacggtgcgatggttagccatatttatgaccactcatgcatcaaccagcatagtctgatcttagcctctgggagccgatttaagtcttgaatgtgatggctaatagatagaattctgaaaatatgtgtatatatgttttccttcagactctctagtctctcagaagccctatctaactagaaggacaaaagaaaatctcagtctttgcattgtactgttaaagcattagaatgtactaaggcaattgtaatcacaaagcattcaaatgtatggtatgcattgtaggctattaacataatcctgtgtaatgagaagatcagcaccaagctagcctaatggcagacagcttctgggatttcaatttttgcctggattcacagaatagtaaaacctcttgggaattcattgcttttttttcagttgtcagaagctaggctctgtgcaacaagtaaagaattctttcctgaatagttattctacttgggattcagggagatggtaaatgtccacgctgggtatcaatatcagagtccgttccatcagtgcttagggtctagaaaggaatggatgatcctgaagccgatgttcagtgatccctcacacttgtaatgcagggctggaataacgtgatgggtaggtttccatcttggttgaacattttatgattctatggttttctttcaatgctaggattgtcatcctgatcgttagaaatcactttagtagatgaataaacagcaagcagtgagcgcatctaatagatttctgacaatagatcgacagcttttctttctctctgttgctctaagtcatttgagaaaagcctggggttacagatattctttgtcaattacttctggaatccccatatctactcttttaggcttttaaagatgagataatatgagtatgctagtaattttgaaattacttcttaagcaaggttctgcattcactgggtagaaccaaaataatgcctttccaaattaaagcatgtgtatagtatataagcgggtatttcttctgagtaagcaagaagatattaaaaacattgaaatgatggaactctgcagaagaaccatatgacgcatgcacaactctaggctgcattgggaaaaccagccatatttgggtttgggattagcctcttggttttgtgcaagttgcttagtgccctgtattacccatcagtgaagtgagtggttcctcccagctctgagatttcatccgaacagcatggaaaacagtagatcattttcaccaaatatctgtgtagataggactgggaacatctgattaaatgtgttgagtgtcacattttctagatgttagaggactctgacaatgtcttgttgaaatcatacttgggtctggctctggactctaaaaagctcttccttaatgacatcagttgtgatggatcagagtcacttgtagatatggtgatgaacaaaagactagtttttattttctctttcacagatgaaaccttattttagccactgacatctccgaatgatctgaaaatgtattgcatacaacacctcaaagtttcagatggacactccctcagttgtatttggaagggaggccccaggggccccttggcatcctctgagagatgttcctgcagacgcacaatgcacacaagtgcacagaggcaactgacttggggtcccaagctagtagcacacaggcatggcctgagtactcagaggaggactccggtggatatgagcagacacccagggtttcacttgtcaccaacacagtccagatgatgaagcaaatactcaatactccaaagaattccttaattatttaggaaatttaaatgggtgatataattactcggttgtctcaattctgaattattcattctgtttttaatggtagtttgatgctagtaactccaggctattattaataattttttaaaaaatcagaagtagattagaaaacagtttcagaggaaggatttaaaagcctcttaatggaggagtggctatgcggcattgcattcaaacagccacagctgaaggctgactgggcttcctccaggctgtcctccttcctgagccagttcccgtttggagtctgggctggagggagctcctggcagtgccatgactcagtctggtgaaaaagcctgtgtgtgttcaggctgactttgaaggaagcacctctaatgatctgcagccagggtggctttgaagatggtaagcatagaatttcaagaactggactttgggtactcgtatgaaatggaacattattataccactaatttgttctctttaaaaaacagtgagagtcttctcatggttttggtagtctctatttatttatatatttttattggtagcaagtgggaataagagcacagttgtttaaacaaacccaagaccattctacttgctgtggctggaaagtgaagagtattggaatcactgttttaagtggctttgctgtttagactgaatgtgcacgagagccaaatgactatttgatttcactagaaaaatctgtaaatctggttattggatactgtataaagccatttaattccacaaatgttagcccacagaaatctgtgcactggaagagctcctttaaatttacaacagcaagaaaaataggtttgctttcctatatactctctactgttagttacaatgacatgaaacaacccaagtttgaatatttaagagtagccacaatcacgaagggcagtgtgatagaaccgagcaatgaacaggatgtaagaaatcctggtttaatcctatctttcctatggttttgcccaaagtggtcacttctcctccctaagcttcagtttttctcacctgtaaaattggggaagagggtgtagatgaaatcagcatgattctgcatgtcagtagtacattattatctcctagaaagctttaaaaaaaaaacttctgatgccgagactctaacccactctaattaagtcagagacacaatggatgaggcccgggatatcaatacatgctcaataaagctcaccaggtcattctaatgggcatctatctaaagttgagaacagtagaaccgtctgaaggtctcttctggctccaacattccgtacctgaagatgctaatggctctttctcaatgtcagagcacgatgcagatcgtcttgtggtcacggtggttctcttgactcttctggtcacgcgtaaagaccgggagtggaaggcagcacctcagcagatccaaaggccatgaacaccccacagtgacttcccaagctagagactgtgagtgtacttggtgtggacaaggcattcgggaaccactgaattaaatgggatatttttattcttaagagcagtgaactctactttcaaggggatgaaacaagtgaaaaaaatactttcccccccaaatatatttgtcttggctacaccgaggtctaatcagattttaggtatacaaagattaataagacacagtccttatcttaataagacatagtccttatcttaaattaatttacaatctagtaggggtgagggacaaattacaatctagtgggggtgagagacaaatagtaactgtgtaatgtgggggtctctaagtctgatattgcttagctatgcagttttctagtctcagaaacttggctaatgaattcaaaactggaaggaggacccctaaccctgtcatttgcccagttaaggtagttgagttttgcgagtgagcttttcattatgctttccatacatatttctttgaaacacaaaggtatctaataaacccacacaaccccacacctgtacacacacagactctggtattgcgaagtgtttacactgatgtgcaacaagcctctatgtacttaaatatgcaaacctatatttacatatttcgataaaagaacaaaatacaataggatacttcatcagtcatgacacaaaggtgaaaaccactgttaactacttgtgaacctcttattctatccttaagcatctggaggcagcttgtgtattagaattattgagcctccgtgtcccagatttgtgtcagaacctatccttatccaagacttcttccgaccagggagagaaacaatagcctgggtgtttgtgttctttgcagctctgaccaggtaagactagttgtctataggtctccttcttgcgttctgtgggtctccctgaaaccattttctgcaggttgttaggaagtagggaaggctattttaaaattgctaatccaaagaggaggtaagatgagatcgtgatacctttttccccaagggactaaccacacaaccaaccaaccaggatagtttagtagaagaagcatcaacagtgctacaaatcagaatttgaatttgtatctttccacaacctagctatgtttgcttaggcaaatttcaacctgcctgaatcagatttcctccaatttaagatgaagctggtaatacccctacgtagtgtttgggggtgaagattaaatttaatattaatactgtttatacagcagctattaaaataactagcacatagtagatgttcagttagtggtgtccaaggtggctgataactgtcatgggagactgagtgcaccacttagtaagatgtttgttccgccaactcagtctctatgaagtagctctgtgtgatgtgggagaggtcatggggttgcagtggtacatttggaaaaagaaaaaatactacctcttagactcttaatggagtaaatggtgtcattgcgtagattctcattagccagttctcccttccctctcatgccgtgtctctggggttgagaccagcgaggctatctttgtatttgaatctctctttgtggtctggcttgtgtttcagtgtatatctttccacacaaaccagatcaactgctttcagctctgggaggaaaacaaagaaacaaaatgtgatgcagtcaaacaatttaatttctcaaagctttatgattcaaataaccaacaacattttacaatgagtcattttgatggccagtaacaccacccatggcttcttctttggccttaaataccgtccttttagagaacgttcttagtttctttttaaccaacagtcaaaaattattaatttggctctttattcatgaacattaaaagctggaagttaataaatattttatgattgtaaagctccaatgcatatctgattgatatggagggataaagaattgaaggcaagagaggcctcctctttccagaatttgcaaaatcaatataacttgggctttcactgatatactaggtgcatgactaacattggctagagcaggtgctgtctgatggaatggcgctgccaggaaaccctgatgctgccccggggaggtctccaggtgagtttgatcattgcatctttccctagtcttccaggtgaggttggctagaatacccaggggaggaaaagagagcgtttatataacaccaccagcccctctagtaatgtcaagatttgagagaagtatctagtagctcttccttctcaaaaggtgatgggttcctgggctgcaatgtatttttgaaaaatcatatctcaatcttggaataataagcaggcaagtctgtcagttaaaaggtacttaagtatatgatttaattcatattatgtaatttttttctgcaaatatgttcaggaactcagctgcagtgttggtttttctttaaagatttttttccctttcccctagtgaaccagaacagattcttggagcttgctattgattacgcagatggatgggtctttctgagctaggaggagagaactaggataaatagagtccattttttttccaaaagcctgaaaagcccatgaattcacctggtattctggcaagagctgttacttcttaaagcaaaaagggcattgaataggtttttcataggatggcccttcaaataactactcctagccaacaaaatattttagaagcttgctttgccatgtgctcttgtaggaacctagaaaatttccattatcagctgttttcaaagaaaatatttattttctttttattttataaaaggaaaagttaattcatgaaatataaataaattctcagattggctattatttgcttaatagccaataataaaagagcaactgctattgattgcagagaaagtcagtgaacaactttgtgaatcaggggtctgttgatagcttattgttaggggagtaatttgcgaggttgagatcctatgctctgactgctgatgccattttctgcaaacgttgcctgagccaagtcactgactggcagggcttgtgtatgtgaaatacaaacatacttgtaagatttataaacgattacatggtcacgggcatcttaatggaaagaagactgctaatcattgacattgaatatgtagagaacacttcttttgtaggcagatagacttattaaggtatcttgagtagttctttaatcaccctgtctctgttgccttatttataaaatagtgataagattacttaacctgttaaaattttgtgagaaataaatgagatcataagtgcaatgtgcgcacacaaggcctgtcacttctgaaaaaaatgttggtttcccttttccctctgtgcagaccagcctgcatttaccctttagctgaagcatctaggccaaggatgtgtgtgctcagtgcatagctattgaatgaggaatgggtagaagattgattgaatgaatgaatgaagctagcttatgttcaataaatacctacattagcatttatgggtgaaccctgaatcagttaggaatgcgtcgagtctgtttctaaccaggctgcctcattactgatattaacatttatattccctgaaagcatcagggaatcaggaaaagattctttcccatgttgtttctgttcttacctggccttctttagggacatgaacttcaggtagttctggctattagccactgtacatagacattacatatgcattgtttgttattctcctttgaatttaagattgctctttgactaagaaagtagagtgtttccactctataatttatcgactaagaaaaagaggcaggagaaaaaaaaccacacacaagacaaacatttaacctaaggctttcaggggacaagtgctggtggatttctgtctcttaatgcttgagtattttcctgttttagctgcacgagtgatgaaagtgaggtgaagactgatttaaaggcaccttttagttcaagatgccttgtcttggcaaagattttaagatgaaacaaggtctccgactgagcaggcagttatcattaaatttcgttttcccattgaatttccattttttcccaattgtacaacgtcttgatagcatcactgattcctcatgaaaatacatattttctacttgataaagccacctacaaataacttctcccatcctccaaatcccacaaatgtgatccctactacaattagctaacacctagtcactagttaatctggtagaccttccagttccttcactgcctcttggttccaggtattgcaccagcactgcagaggcaattagggcagaggccttaataagaaggcctccactgaacttaaagccaggcatagggaattcgtgaaagaaaccatagtaaggtgtgagaattgccagattaagacagggataaagtactcttgaaatatccaaacagaacacttacttttgcccagaaggcagaagcttgaggaaggccacaagaaggagatatttcaattagatgcttttataaatgaattttaaaaatccccatatgggtcaaatgaattctaagtgaagaaaacagtgtggtctgtggaatagaaatacggaattttatagaatctcgtgcaaacaggaattattttactccagctagtaaagcaggtgtttgaagcaggtggcggggagttggcatgagggtggccgtcagtgaggccagagaagaccccaggccaggtggaacatgtccctgttgtacggaagtccagagctagtgagctgatgctcatgcatcatttgaaatagtaaacatggaaattaaggcatgtgctgttcagaaggctcagtaaataacatgtggagttaatgcttcctgtatacatgtagacttaggtaagcaaagcctgaggttcttgggccttttcacttgctattgccatggaagagccaacaaactatctctctcagttccagcagtcctggttcatggctatttacatgcaaatgtcaacaccagattgaaaacatcagagtgattttgctataaataaaaagtacattagacttttagattttctttgggatctgttagtgagcattacctgtgcgtgcagacctgtacaagacatcttggaagtgataggaaaaaacagcattctcgtgtgtagtagatagattcctattttcacacccttctctagatatctgtcagatgatcttatactcatatttttgaggaagcaagagtgggatatctgttagagccccatttgggcaaagagtaaatagaggggcacagtttttatggaagcctggaatgatggattacattttaataaggagagaaatttggttgcagggatacgaataagcaggttgaatggaggggcagactgggaggctgagtctcaggaccgcagggccagagcagcacctgcaggtgagaggtctgcagagaatggcagcatgtttggagtgcatgtgaggcaggggcatgggggcttagagtgctcctcttctcatggtgggctcacatatgtgatgtctacttgtgtttggaagcctgggtgacaggtagaccacctgtgaaggatggggaaagagattcctcactttagtagcattatcaagttcaagcaccagtatggaaataggaagaaagcaaaagtatgtactcctcccggctaagcaggttgtgagaatcccagcatccttgcacaccctgggatgcgctcaccacagaggggtgtgcgctggtctcaagggaaaaacagaagcaggcctttttgaattgaagtgcaattggtgtaatataggcaaaatagcaactcttttcctaaaggaacatatcgtgcccaattttaattagctctgatgaagtctaggaaaatgggtgactcgtcagagaagctgttaaacttcagagaaaaactgcctatagccccaaggtattccttactttgacaaaattcttatttttccttaagtgtttgtcactgtgaaacccgtcccatttccaggtgccgtcactgttggtatagcttgaaaaagcaacacacttcctatggtaagggcagcttatgggtgtttgcaggtgcaaggcaaagagacacaaaaatctagatgtcagaaagaaaatataaccagggggtgaaatagaagggaattatcataaaaatcaagatgaattggtaatgaatcagatgcatatttttttctctttttgaacagttttattgagatattaatggcatacaacaaattgcacatattttaaagtgcacacattaataagctttggtgtatgtatacatccagaaactcacccctcaatcaagatgctgaatgtgtgtgtctctcctgagagtttcctccacgccctctgtgacacctcacctcgctcctcccaggcagccagagatgccctttctgccatggaatgtttgtgtgcatttcctagaacgatacataaatggaaccatataggatgaattctttcgttgtcagacttccttctttatcccttccaataggcgtatagcaatatctcattgtggtttcgttcgcacttgcctagtgagaaatgttgttgaaaagtttttcgtggacttattcgtctctcctctgtcttctttggtaaaatacctggtcaaatccattgtcagttgtataattggattttgtcttgttttattttgttaccatttaattttgagagtttcaagaaatatattctggatacaattcctttgacaaatatatcgttggcaaatattttctctcactctagctcttcttttctttcattctcttaacagtatcattagaaaataaaattcctcattttgatgacgtccagtttgccagttggttctcttatagattatgcttttggtgactgcctaggaaatctctgcctagtagagagggtcacaaggttctcttctatcttttttttctagaagttttaacatttaggtctgtggttcattttgagataattgtatattgtatgaagtacgggttgaagttcattttttctgcatatggctatctagtcattccaataccatttctcgaaaagacgatccttcctccttgaaatatggcagtaacaaattatagcacatgtgatataaatgacttgcaaagccacacttccaacctgcattaggaatggacggttacaagggccgctccaggagcccacctggaggaaaatggaaactgccattggctggcagcctgttgggtaagaatggaaactgccgttggctggcagcctgttgggtaagaatggaaactgccattggccggcagcctgttgggtaagaatggaaactgccattggccggcagcctgttgggtaaaccgcatcaggctgcattcacggatgctcttctgtggcactgatgggatgactccaggaagtctatggggaagtaccacaaaatgtggaggaagatggcactagacacctgaggagggaccacatgacctccatccaggtgccaaataattacagttgagatgatttccctgcctctactaacccaaattcacccaaattcattgtccacgttggtgttaggtgatatttccaaaaaattctgttatgccactcctttgaaaatttcctaggaacctcaggtaggtccttcttcttcagagttctagaggacagcagtgtgtccttgcactccctgccatcttccagcaggaccctgtgctcagccctgctttccacctgtgcctcgttcttacatgccttgtgtgagggatgtggcttttccctttttcggtttggcaaacaccttctcccttttcaagaccctctctgaaaacacctcatgtactcctgttggtattagcccctcttactttgtgccaccagatcagtttctgtctctaaatatcattttcgctccatcggatagaataactgttcctcctctcctctctgttctgtgtttccccacagagctgtgatggatggaggcctgtttgctgttagatctgctacagctggaatgtaatcttgcttggagtaagaacttacaaatgggccgggcacggtggctcatgcctgtaatcccagcactttgggaggcagaggcgagtggatcacttgaggtcaggagttggagaccagcctggccaacatggtgaaaccctgtctctactaaaaatacaaaaattagctgggcacgttggttcacacctgtaatccaagctattcaggaggctgcagcagaagaatcccttgaacccaggaggtggaggttgcagtgagctgagattgtgccgctgcactccagcctgggtgacagagcaagactctgtctcaaaaaacaaaacaaaactcacaaatgttcatttagtgaatgagtaaatgaattcagtgaatttctgtgttattcatactcatcctactttcatggagtttttatgaaaaggatgatgaccttcagccatggggagcattgcactgcctccttccaaggaccacctgggctccctggccatgagccagttgccccaaaggcatttgacttagattaacctgaaaacatcgatgtcatcatccctcagccctgctcagaaagctgcagggagccttcaccctttcaggaccgaggccaagctccccaggctggctttatacatcctctaacagaagctggccctatcccgtttccacttaattgactcttccccatgggatactctccttaattaaaattcatctctaccccctaataagcgtatgtgttcctacctccatgactttgcaccctgaaatgctctcagattccagtaaaatctcccttctcctctttaatctccaagtttctatgttttggggctctgagtctcttctccccataaagtctccctttctgaatttccagcctcactgcccactgaacatctaaccagatactgctttgtgtattgagtttgatggtataattagatggtgtatatttctgccacccacggcacagcctggtgaattgcaatctttattcattgatattgtgatagcagtgaacttgggtgtggggaaagtttaatgaaggtcaagcagaagatatgtaaagctctaaatacagagagtgatgatttattcagagaaataagagaatccatggggaataccagactctagcttccttgtggacaagaagcattcctgtgcctctgtgtgctctgtgctccttctccctaactagatccccacccttgccctagcttggtgcactgataccatacgtcgatgcagacactaaagagatgacttccacctcctcacaaatattcaggtagaagaccttccctcggaacacccggtcatcagagagtgttcctgatttcgcttttgcaaacaagaggtagtccagcttggaagaacatccagcgccttccctgaaattcatctgttctccactttccactcttgactgtcataacaaaggacagttgtaggtggtgcccagtgacccaactcagtcagctttatctattggcaataaggtagtattgacatatcaatatttccttgccaagatgctcatttgttcttaataagaatcaataatgttcaattaatatagattatgtcactaagtagttaatttagaatgtcgttgctttgcagttcatatcctaacccacctgatcctaacagcatccacctaggagcccagaccgttgggaaggagaagagcagaaaacctaactggtccacctggaagacctagaatttcattccagcaggagcggcccacccaggaaagggcctccctcccacagcagctgctgggaatcactctctttgatgacatcattgtcatctgggcagggagcagaaccattttggggtttcccatccattcagtgctcccactgaggtcttggagtatggcccagatggctgtagatgtgcaaacttacgatcatcctggagcacggggccctgtgtcatatggatcctgcttgatgtgtagatagtgcattattttcctacttgagctctttccttttccaggtacatagacagggttgccttgaggcttagtcacccttcgcccattctgtcttactactacagagggtgagagactggacaaaggggccctcagtgtaattttcacttcacatattttattattattttttttttgagatagggtctcactctgtcgcccaggctggagtgcagtggcgtgatctctactcactgcaacctccacctcctgggttcaagtgattctcgtgcctcagcctcccaagtagctggaattgcaggtgtgtgccaccacacctggctcatttttttgtattcttagtagagatggagtttcaccatgttggccaggctggtcttgaactcctgacttcaaatgatctgcccgcctcggccacccaaagtgctgggattacaggcgtgagccactgcacccggcctcacttcacatattttaaatttattccagtagtctaagcattatgcaactctggttagataatgaaggtcatgatacacctagaaggttacagatttcaactggattaaccattgttatacaaacatatgtgcatgtggatatcagaggattcagagcctctctcctctgttttgtaaattgaccttcagtctctcatcttaggaatgactcttggccttggatgagggcctgacgagggtgggttgagttggtaaaacccggctgtgttagtttccagtccatctgaacccacagccccttttcctggctttccctgctatagcccatgaacacaatcacagtttctgttgatcatcgttatggtcctcccaaatccttcacctgggctattggtttactagggttttttttttttggtggatttgcccaaatgtggggacacctggcaggagacagcagctggggttcctcgaggctgcttggagccctggcccctgagtcaagtcctcacgttcccttttatttccttctcccctaattgcaagtcgtcaggagtttcaaatgcccaccaacatttggagaaggcttgtgggctgtttgcaggctattcagccccaaaggctgtacggagataggtgtgggttatcctaagcgtccctgctcctcatgttgtcactcatccattttcagtaggcgctgctcctaaaatgcacgttaatattgatgctgtttcatccgggttcttttcctttctacattgcctcacctggtttccactattccctagtaactaggtaggagtcatttttttagatgaataattgatttgcttaagggactttgggcaaacttaattggtagctgagttagaagtacacattttgttcatttatttgcccgtcctttagatattcatgaagaatttgcatagaagcctagcactgagtttataataaaaattaacctcatggcatctatactctcagccacttttttttttttctttttttttgagatggagtcttgctcagtcaccaaggctagagtgcagtggtgtgatcctggctcactgcaaggtccgcctcctgggttcaagtgattctcctgcctcagccttctgagtagctgagattacaggcacacaccaccatgcccagcttttttgtgcttttagtagagacaggttttcgccatgttggtcaggctagtgtctaactcctgacctcaagtgatccgcctgcctcagcctcccaaagtgctgggattacaggcgtgagccaccatgccctgctttctcagctactttaaaacaaataacaacaaaaaaatctcctgattgtcagtgcagagccccgcccgtaatgcctggactcacaggctgctgggcttagcagtctcctcaaccccagctgcacaatggaattactcggagcttttaagaaagaaagaaataataataccaattcaaaatcaaacacggaacacatacatcggtcatcagtcacataccatagattcttatttaatcagtccagggtgtagcttggctttggaaggctttttctttcctggctcctttttttttaaacaattttttattgatgcataatcaatgcatatagttttggggtacatgtgataattaagtacattcatataatttgtaaagagcaaatcagagtacttaggatcttcattaccttaaatatttgtctttatgctaggaacattcaaatgattcccttctcgctattttgaaatgcacagtagatgagtgtatgctgcagccaccctgctgatctatcgaacgctagtgtgcagctgagggtgagaaccgccgggtggagattggaggagacctgagtctttaataaacactgagccgctggggaaaaggtttgaggggcatttgctaacacaaatgctaaaggtcagtactaaaaactactcaggccattcttaggcatttttgtcttagaaaatgtcaaaacagctgtgacctcatgatttctgtctcgtgaggactctgaagaatgccttagtgctcctgaattaggttgtaaatattgtacttttttctcttgagttttctttggaagaatagtgaatgattaaaagaaaaccaaagcagtactattattttagaatacggaaatgcaaggtagcaaagtgtctaacacctagaaagttagccccgcctggacaccagctgtgaagctctgtattaattgaacaaatgctgtccaagaaagcaaaacttcctaatctcttctgatggtcctcaatataagattagtatagaatcttcttagaattggtttcctttaaaaaaaaaaattgtgggcttctcttccccatcaaaatgacatccctttgagattaatgcaggaagcagagggcacggtggaacttgtctcgctgaatattctgacgtggtcaagtttcctaatcaacagcagagatacaaacttgcattatagttgtgggtggtggggaaaggattgcctttttttgttgttgtttttttttgagatggagtttccctcctgtcccccaggctggaatgcagtggtgcgatctcggctaactgcaacctccgcctcctggattcaagaaattttcctgcctcagcctgccgagtagctgggattacaggcacctgccaccatgcccagctaattttttgtatttgtagtagagacagggtttcaccatgttggccaagctagtcttgaactcctgacctcaggtgatccacccaccttggcctcccaaagtgctgggattacagatgtgagccaccacgcctgaccaggattgtcctgtaaaagtgaatttttctaggcaattgaagattgttaaaagtgggttaaggcttatgcctacctaaaacattcattccaattagggcctcatccacatttaaattccagattctgaaaacccttcactcctaaataagaaagtattggggcagcaggtcccacgccggactgtggaggttggctacgtgcagtgaatgagtcatttctgtaccctctagtgtatgtgtaaggtacagctgcagatagatccataggaaacagggactccaagaatagcagttagtaaatccgtgatccgtgtgtcatggttctattgaaaggaaagtgtaaccacatcagtgggtctgcataccattgaaaagagtttctcaatcaaaaacctaaacacatgtcctgaaaccatcacttaagcactctgagatcttgatccaattacctaaacttcctagatctgttttttaattttttttgttaaatcattgcaataattcttgtatcacagagttactccagagattaaataaggcagcgcatctcaaacacttaccagtttttgttaaattaggacctttttcacccactacagttagtagtacctaaaagtggagctacgactagttttcttggagtgagttttgggaatttaaataagtaaatcgtgtgatggagtttggaagtgataaagcactatataaaatgctcatgcatttccccatttcccaaatgtccatggcatgagtcgtgcattccagatgcctggtgtgttctgggaatgcaaggctggccatgcgctgggtctctcctcatagggtttacagtcagttaacagcaatgcacacaaaaggatgtattgaaatagatccattggaggagtaaaaatacggtgacaataaggggacagagaagaaaacagacaaccatggccagctcctaccggaacagtggtaaggatgccgaacacattcatacatttctgtgaaaatgcaagcccttccatttcattttggttagtaataatcatatattttggccaggcttccctcccccaatttcctacggctctgcacttgacattcaccaaaaccctgttagtttcccccaaaccggacgtgattccactcctccatccttctgcccctttccgagcagcttccttcagggctcacccacacctggaattcagcaccagctattacatctgcatgtcggctcctgtgaacccgtcatcccctcctactacaggccggggccactgggccctgttagttcagggcccctccattccccagaatcttcttccactcacaacagggcaagggtttttaacatgcctccttccttccatgccttgagcttcttgcaggcaaataacaaaggcattttgtctgagtccccagagctaagcacagaacctggactatattaggcctttaatttttttccaaatgtcagctaacaggcacaggcatgcatacatacacacgaagcattttatttttttacctgatggggacacaggccagggtttgacttaggagtacataataaggattgacaatcaggacattaaagcagataactttgggttcaagttctgattttgccgcttactaggtggtgaccttgaataaattacttaaattaagattttcccactcacttgaaaatggggataataaaaatcataacaatacattttggagagtattaaatacggaaatgagctaaagttagctcatgcccggcatataatgtttgcagctagcatttagagtgcatggggctgctgatgtgttgatgcctgaagttgcgcaaatacaggtgggtagtggaatacggaaacaatgatcccataaaccaggcccaaagccccatcactgaaggaatgcttaccttagcctgaattttccagtatcctctacatgccacaggcagagccaccacccagagttgaagccatctgaaggtgacatgctgcagccttgtcctcgcaggtcattcttcagcctcctgacctctgctcagaagcctgtctgtgcttacggactgggctctgcacagctgtcacatcctatcactgcccctccaggtttgcagtcaaagaccacagcagagatgaggcataatgaaggacagacacacccaactgagcaccaagcaagcgacatatcctaatacatatgtgcgatgtgtgcatgtaagggcaggagagcaggagagaattggaggaaatagctgcaaccaaaagtgaagaaataataagacacctggaaagaggcctctctcttctgatctgtgaggccgtagtgcagtggaagcgcctgatctagagagaggcaggcggatatttgtccaaactgcagctcacacctgtaaccccgtttccctcctcaagtcgtctacatttactttgcctcagtttcttataagaagatagaggcagtaacatctatttttgtgtgtttttgtgaaaatgacatattatagagaaagagtctgttaaaaatagaagtgcttaataaatagttgctattgtaagtggatgtcagaggagctgttacaatatatcccagaaagtgagccctgggaaggcgccgattttccatagcaatcctgtttctgctttacagttgcttcctcttacgtgcatttacctgcctggtcatcctgcagggcagtgccacctgcgcagtggtgtgttgcatccaggaacaatgtccacatgatcagtgtcaggcacagagtggcatgggcatcctcaccattctgtctccagtcccatccgtggacaaaatgccccctggaaagttgaacagagattgcttcaaatgggccaaatatgcattagtgaggaactaaactgctttgacagctcctgtgtctcctggatgggaagtggggagggagtcatggagttttaatctcatcctctttgtggcactgggcacgccactcaagatccctgcttatttccagcttatagcatagaatgagaagccattcacccttgtgtagagtgatgctgggaagaattaattattcaatgacttaagggtgcttctgatatcaaaagagcccattatcatcatcggcctcctctccccagtgtgaacacacggcaaacctgagactcattggaagggacgctgctcagacctgcgagccccatttccatgggtaggtgaaatgtctcatggctgccgacacccttgcggcaggtcctgggcgtggttaagtagggggaaagtgtatttcttttctgtggcaagatttattctgtaggagagctcatactttggaagcagcaataacctaggactgctcttaactagcttgatgaccttgtgtgtgtgtgtgtctgtacgtgtgtgagtatgtgtacctgcatgtgtttataccgtatatatggatatatgtgtactccggaactcataatatatacagttataaccattgttcaatcataagctgaatatgcatgagtcactctttcctgcactgaactccattttgtctgtcacaggcgttagatgacagcttagatcatagcctgctccaatctttacattttaataagcaccttttttcaatgccactctgatacaccctctggtccttcattagtcattgctgatattatttctctctaagtgcttcttcctccattttaaagaacaacttcgatgtggttttttttttctgttttttaaattaaactttgtattttgagataattgcagattcacatgcacttacaggaaataatacagagagagcccttgtaccctttccccagtttcctccagtggtaacacccaggacattgacatggatgtagtcatgatacaggacatttctgtcctcacaggacccctcctgttgtctttatgaccactccctccaagccctacccatccagaaccctgacaaccactgatccattctcatttctataatcttgtcatttcatgtagttaaataaatggagccataggtgtgtgaccttttgggattggcttttttcctcttggcatatttctctggggatcatgtatatacactgatatggtttcaatcttggaggaatcctgattctgaaatcctagagtccaaatctgatgatttcagggctgaacagttcccttctttgagtgatgaggacctgaaggctgagagacctgaggtgtcatgcccagggatcacccatggcacagcctgagctcacagcagagatccggcctccaggcccggagcactcctccgccatgaggtcttttacagctcagactgggcaaagctctttttaattccaccaaacctagaattgttaaaaaaaaaaaaaaattaattaattaattaactaaaaacgctcaagatgccctcttactgccagccacaaaggggattctcagccatcccagcctttgtgggcactggagcagccgtggcctctcttggtcctgcctgtgtgtgcaggagcaggcacaagtgggctcaggctgatgcccccagaccaccctcggcctctgacccttgcctgaggctggcctccacaccatgatgccatccaaggaaaggcatctccttaatgcctctgagagttccatttgtaaacatttttgaatgaaggtctctaaagaagcagccaaagggcaggatgtcccacaacacaaaataagacatcctccttatgctgtctctgaccaaagtcctcatgctcacacagctggcccttccctctcttctcttcttctcttccttcccctcaaagaatatcccagcctctatcaaccagcaccgtggctctcatcaagatctttgccggtcctcggcccttgttctccgaacctctgtgctctcttacataaattagcaacctcctctggcatctctaagcctgtgcaccacccattccccttgtcccatagcacaggcagcacagaggcatggcatgccagagaaagcaaagaagggagaagccttaaattcctgtccttgaatatgctcttgccccagacatattgctcatcgggggtcataacagctcgcaaagcaaccttttcacgtacctgagaaactctcccaacgtgtccaagcccgtatagctgagtcacttgacctttcttcactatgacctcacctacctgggccctcaccaatccatccagataattgtaagattgtataaagttgaccgctttctcaatgcattctcttttctcatcaagatatcagaaatctttgacatgccctagaaaaaaatgcatgtgatacggggttttactgtagagcgatggaaatgttttggaactggatggaagtggtggctgcacaatgctgggaatgtactaaatagatgacatggaattgttcactttgaaatggttaatgctgtgtgatgtgaatttcacctgcatacattatttttaaatgcgtatggggtcacttccaaggtgaagtgcccagtcttctttcagacatgaggtgtagctagagcattcatgaaggtatgcaaggaagggctgagatgagcagcaaggggtggaaaggaaagggtaccgaagtgctgctgtgctccacgctggccccttacatagctggagacacaaaagtggggcctttgcgtatccagattcgaagaatttgatgagggcattatcaagatgaaaatgtggaatattgttgttggcaaagccacattaacacacccacatagcacacatataaaagttctaatgactgtctggtgctttaaaatccagggcttaatacaagcaactcaagttaaccaatttaactgtgaaaacccaatcataggcatttcctgacattttgaatttgcaattgtaatgccgttggtgtccatgtagtaaaaaagtgcaatatttggaggatgcgtattttacttttagattttatatatttatcaattggcatgatcttaaaaaaaatctagcattaacaccaaacatatacaagtgttgtatttaatgtctgtgcacctaaatcagaccagtcagaccacttcacctgttgggctctccaaagcttttcagaaacacagcttatcattcacggacacctctgaagaccagaggcattgtctgctgaggctgcatagttgcttagggcctgaaaactttgtatggtagtttgtaatttgcaatgaatcagttacagccagaattaagatgattttcactctaactacaaaacaagtttgactgtaaacaaacctagagcaatatacagagtatatctggaagagatcttccaatacatactatctttttataaatgaagaagcagaacccagagaatctttttttggaaagggaatttgaagaagaaataatttttttaacgtagccggatgcgatggcgcaggcctgtaatcccagctactcgagaggctgaggcaggagaatcacttgaacctgggaggcagaggttgcagtgggccacgatcatgccactgcactccagcctgggcaacagagtgagactgcctcaaaaaaaaaaaaaaatttaagaatatgtgtattcccgttttttacatgtaattgggtatttctaattacatatcacttgttttttattcctgtgatatgataaagaaaacaggcattggttactggttccttgttatttaataaaagaaagaaaaataaacaacctctataagtgttaactaacttggcaaagcaagccttgatttccggcagtcacttagggaagaaagaggccctggaactctggaccccataatatcaaaaactttcactactggaatgcctcatagcatttacagagatccagaaatggaggctgcaaaaattatgactaggtaagagttggctagagacaaggaagcatttccttggccaaaaatagagctgaactctccttgctgttgccagcattacaccacatacatttccaccagttatttgaagaccccttcacaaccaaagacagccagggcttcgcaaggcccagacaccccgctgactcatcccatctgcagcgtgcaaagtgctatttgtcactgcctagttatattccactctgcccaacagaataaatattaagtaagcgctatgtacttacataatttgcagaattgatcggctgacttaaaagcttgaatccccaacaaaagaaaatggagtgctttgtgcaaatgttaaatgcacagtttaattggcaattgtgtgttggaaagctattgtaaaaggatcacagttttgaggtgatgctccagatagcacagtcagggaaataagttttcatctttggcattaaaaaatcaggtcttggaattgaagtaaaaaaaaaaaaatagggcagcctcagtctggatctctgtctcatcagaatataactttcttcctcctacactctgcctcctaaatcagaatttagaacatattaaatatgtaggctttaaagattctttccttgcctaaataatttatacacgtctactaaactgttaaatatcaaagaaacacatgcacatggacacacacactcagagcattttacaacagtgatttccacctcccaaaaatttaagaacgtgctcagcaggaagttagagttgtcaggtcccctccagtggaaacttaaagaaatgtgttgtattttgtttcaatgaggatctggatggagagttcgccatcttgattcacgtaacaaaaataggtgagagatacatgtgatccccgaggagaactattagacttcccttagatgcaaaggttgtctcagtcgtgaaaaaaacgtgtgtcatttcagcctattcagtgcattctgcagcacctgctagaatatttatcctccttctctttccacttaagtcctacatttacataaaggctactggagggttccatgttgaagcaggttttatttgcaaaactcagcctccatggatgtgtctttctgcagcattcctttgtgcctctcattatcacctaagggtttataaaatgggcagtggtaactctagttttaaatctagttaactctagagattaaaatccagtaactctagattaaaatctagtaactctcagctattgtgaacaagttgaagttaaaaaaaaaaaacaaaaaacctttcttcagctgcgactgaaaaagatccagtgataccaagcgtacctagtttccatcctcataaaataatctcttaagtgtaaagaagcccagtgcaaaccaccatgaattatcatcatcgtttcctacagtgagttcggaaattgctttttgcttctggatactgtgaaaagccaggtcaggaatccacaatgggcatcagtcatcattgtgttgctaatacttgccatcggttcaagaataggaatattaagattgcatttcttcattcttccttgccaaagggaggaacaagacagtcaaagggcatggacccctggcccttgattgaaaacactaacagatatgcatgcagttagaccccagtgttcatgtgtccaaggcaataggacttccaggagagacatccaagtgaggaagctgcaagtgctgcctggaaacacctctatcttcaaactccaccctctctggcttggttgggaaaacctcattactctcaattttctaccaaatgatggtgaagaggagtcatttgttggaagaaagggattcattacagggaaacaggtcttgaaaaggatcaataccatggctgcctccttgtccagccaaggggaacctgtgtggctctcccaagcctgctctccttcaggccctcagaagttcatgctgtcattaggacagtcctgcagtcaatggcagggggcgtgatgtcccgaggtgtgtgaggtcttccctgagcaaacctgtcctttccagtgacctgccacggtgcccaaaattctctcatccaacactgtgttagtgagttgcttgaactctggggccaggctgcagaattgagtgccagcttttcttcttactaactggataacttctggcaaaatttaaaatagcagtaattgcagtatctacctgataatggtgttggaaggattctatgattaatacctaggaaaaacttgtgagtgtctggtgcattctactatgcaataacattagttatttttattatttaacctcagtgtgttgtctggcaaatagaagacacagtcagcaaaacacagaaattcgttaatgaagtgaccgccaggcacctggacgagccctgagggtataggcaaagacatgctggtagaggaaggggtaagagagacctgaaaattgaggtctgtccagggaggccgggctggagacaccctgagttcctagaaagagcaagttatctatgagggagaagagaaccattatagtggtaattgtgcaaaaaggaaaaaaaaagacaaaagaaaaaggcagccgtaatcgttagatgccagggacagtgctaaccactttatttatatcatccaatttgatcctaaagcaatcttataagctgggtatattctcatttcatagaaaaagaaacaggcctggagtgccctctcagttagtcgatagtggagctgggagctaaactgttgcccaaactggatccatccagctggcacaggtcataggaaccccggggtctcagcacttcccagatgcctctgttagtgcttcctcttacttggacccagttgtcttaggaaagcaagacagcagagaagcccagctcctttctctcttcctggtacagaaccagcatcagcattatttagaatccagatgtggccaatgtgggatggctggaggagggaacaagctggcagacagcccccacctgggcataggtacatgacaggagggaacgagcaggcagacagcccccacctgggcataggttcatgaggaggaaaacctgccaggaggattccacacctgagtcagggagtcactgggtttttccagcgagcacccctcacgtccatctccatgtttcttcccgaccccttcgctctggaagtgaggagagggaagtgttaccagttgatgttgtttatgtaatgctaggatcagccaaagagtgaacatcctgctctttcaaaatgaattgttggtttgtaagggtgtttgctgaccttttcaccagtaccggggaagaaatgcgcatttatggctctctttttggctttagaacagataatcccagggcccaatctttgccctcttctccacctccatacacacaaggaggcattggtctgcggaaactgtttactcagaggaccagtggccctcgtgcaactgcagtcaccaagttgccatccgggctgcagctttcagctggctctcctctgtgtctgtgctggaggtgatgaaaccccaggcttccacctgccctcatcagggtccacacagggaagggacagccttgtcttgaggcctttcatgctgaatctaaacctccccattatgaattgacgtggtgttacttgggaagggatgatatttctcaaactcctcctgtgggcttgtcacagcgccctgccccttcctccctcatctcagctgcccctcactgggcatcggggacaggcaggtattcttcactttatacatgagaaaggcaggcccagacagggtgggtaccttgcctccatcacatggctcatcagtgctggacaatcgagtatgaaactgccatcactcccatgcctgcctcttctctgtggagacaacttcaacttcagaaaacgttagtgagtcttatcatattcctacagccacattccagaacatgctgattttctcatttcaggacagtttccccaggcgctttcaacttcttataccttaaaagaaataccaaatgcattactcatgtctgtgcagtattccctaagaaaataaagacatctagctcataggaattccagaaagataaatgaaaaataaatgaggcttcagaatgctcacaaaacaaggactctatttgccttaaataattaacattgagaattcaaacctgaccaacttttcctccatgattaaagcaacccagggagagggcaggtgattccagtgctgggggtccctttagccataaatgtatggacgtgtgatgccgtagcactcagggcctgggagagccggggagcatgaggatgatcgaggtctcggagctcaatcaatcagcaagtgcttcttggtcacctattgtataagtagaaatggatgccctatttatttatggaaaccatcaattgttgaggacctaatatgtaatctcatctaggataaaatccttgaccttgaaaatcacaatcagctgggagagaacacagagtaattgttagaatgcaagatggcaggtgccatgacagaagagcaggatggatgctgaggagcacacaggtggggtactagctcgggcctcagagcaggcaggaggacctcatccaggaaacatctctgagttcacttcccaaggacaagtttagccccaggacaaggaggagatccagaaggcattctacaaaaatgctcaaggaacaagggcattggagcacaccatgttggcagggaaacagacaaagaccagacatcagcgcttgctcagaatcctctgctgctctcgaagggctgtgtcctccacaggtgggaggatgccacctgctctgatggtccaagcagtgtgggttcagccagcgctcttggcacctgggagcatgattccaaatgtagacgtaatccagacctgcagcttcaaaaaaggagccaccgtggtcagggtcagggctgacacagggccaggggaagagagtttgcaagtagcaattcaatacttttatttcagaatgtgtagcaagtatttgacatatatgtataaacaaaaatcatataaccagtttcctagaggtagtccaggccatgaaggctgcaacttattgtttctctgccctgacttaaagcatgtgtttccaagttgatgcctgttctttttatgcctcatcaccaccctgagtgttcagtgaggaattgctgcaaggacaaagagttcccaatgtaatgtggatacaaaagaatccaaccactcagcttcatcagtgcccttggcaatgcacgtccaagaagcctcgcacacagagctgggaggccatctgaggtctgaccactgtgcctgccagaagatgagcattctgtttgtctctacagttgtgtgtgccctgtggcactttcacatattaagatttgaaccccaccaccccccaaccctgtgactgatccccacagcctcccctttagcctgggtgaattaattgaaatcataggagcagtcttagctgtgcccgtcatgcggtcccttgagacaaatgcattcggtagatgatacatgacagcctgaacacaggccagggaggagaccctggaaaagcagggacagaaggaagacaacttcccagccagcggccttcgcttcaagacagaatccactctcctccctgctcaccagtaacatgagggctgagcaaatgggaagatggtctttgagagttatcgacttcctccttttccagcaacgacatcatgcctctaagtagcagttcttaggaaacatgaagcccccaaggacagctggctggaaactttcaaagctttgcaggcataaccactaatgaggagcaaagtcgctgtttatttgagatggtgacagacactatcagcacacttcacacagttcagatatgtgtttaggttcagaatgatggggatttcaagaccaaaggctctcgaaaatttcagcaacccaatttattcaccaaagcattaagccaggatctattttacatcagattgtttgaaatagtgatgtaagaaatgtgctcttgatgtggagcctccagaaaaggacttgatgtgctcatgggttctcatgacctctgaggtctttgctgcagagaattcaccagcctagtgcctggcacatcacaggtgctgtgttaactgaaagaatgatgaattattaaataaacagccactgtgatgtggagaggaaagagttgggcacacttgggttcaaagagcaccacctccaaacgccaccttgcctgcctacttctgatggacactgttagcaaattgcttaaacactccaagtttgtgtttccttatcagtaaactagggataaaaatatgtatcttcactgggcatggtggctcacacctgtaattccaacactttgggaggctgaggtgggtggattgcttgagcctaagagttcgagaccaggctgggaaacatagtgagacccgtctttaccaaaagtagaaagaaattagccaggtgtgggggtgtgtgcctatagtcctagctagttaggaggctcaggtgggaggatggcttgagtccagaaagtcaaggatgctgtgagtcatgactgtgctgctgcactgtagcctgggtgacacagtgggatccagtctcaaaacaaaatatgtgtcttgcagtgttgttgtaagccttgatgcactctttcctagtgtaccgaagcagcctaataaatgttagccccccggttgcctttccacttaaagagagatggggtgtattagcccattttcacagtgctataaaggtactacctgagactgggtaatttatgaagaaaacaggtttaattcactcacagttctacatggctggggaggtctcaggaaagttacagtgatggcggaaggtggaaggcaaaggggaagcgaggcatgttttacatggcagcaggagacaaagcatgcaggggaaactgacattttgaagccatcagattgcatgagaactttctatcatgagaacagcatatgggaaacctcccccgtaatacagtcacctcccaccaggtcccctcctccacaggtggggattacaattcaagatgagatttgggtggggacacagagccaaaccatatcatgaggaggttatatcaagtggatttatagaactgagaaacagttgagaggctctgtggtgtgcggatggttttggaggttaaacaaaacaaagaatactaataccagagttccttccttgaagccagttaagatcgtcacactcaaagggaagagatagactttatcttgtctctcccagtagattgataatggcaggaggagaaagggcctttcctatcctttctatgcaaaagtgtggtgtctggaacagcatctgggtgtcaccagacagtcttttggaaatgcagcatctcagcttccacctaagtaggctggcccagaatcaacatgatgaggagatccccaaatagtttacttgcactttgaaaagaaacactggcctagagcaccttcccctctctgggtcgccaggttctttgatttattaagtctctgcagctgactgatatggagggcaagggtacttttgaggaattttctgaatagtaggctgaattcttcaaccagccaaccaaacaacagcatgaatctatcttatactagatacgtactgcttcttctaaaaggctgcagagagggcagtcgtgggcccagtgaacagctgcattctggtcggtcctctttttcccttcctctgccaggaaccacagcagtgttgaggttctgtaagcacgtgcccagttggcaatgagcttatctctgagcatctgaacagaggagaagcccagagcagcctggctccagggaccccacgggacgcattgagtgctgagctaactcagggaggagaccacaacaaatacaaactctgggaaatcagggacagggcaagcctcttgggattcatccccggcggacatgcccagagactgtctgccacagcttttggcaatgacagatcttaccatagggctcctactaaataccctctggaaaagcactggacagtgacccttacttgaggatgcataatcaagggtgtggtcatgtagccatcataacatagggatttggaagattgaggtatgcggaagggccagttccaggaatagagctcatgcttggtccaaggactagggcagggccttcaggagctcgtggctttgaggagggataaaggagaaggattggtagcaaatggcccagagattcttacaaatccaccttcatccataaggaggttggagggtgtatgatgatcctctcttctaaaaggctccctttcaaattacagaaccattgggtaattcttctattacccagggaatcagtgccagctccccaggcactgagtcccaggaggaagacagctcatcttcattcgtgggaacctgtcctatatgtgattgtgcccttgggtaaagtggactttacaagttcgttattgctgttgtttgagcagaggtcatgttttttgtgttactgttgtttttttttttttttttcaaattataaacctcatatatatgttaaagcttaaattcaatctgatgtagagatttaactgtggaagtgaaacctctctaaaaaaaaaaaagatcctaggaaacaactagaaatatgagatttattctaatcctaattgcatgttccatatttagacacccttcccacaaaaggtgagagaaatgcttaccttgtccaattttacgcacaagcctccactttaaggaaacagattactttttttttttaaagaactctcaaattacccattgataaatacagcactcaaatttttttttggaaaaggcacaaaggtaaacagataaaggagttgagtggtcacctcatgacaaggacagtttgagggtttactcttgttttcatgggagcattggtgcgggttacttcatctgaaagaaactttgagctctgaagctatgtctagcacatgttaagtaagagtggtccttggaaatttcaagcgttggtttgcatggaagcacaaatcatttgacccacatgaaaagaatgaaatgggatggaacagaaactcaaatttaaagtattaagtgcttttgtcaactgcaaataacatgtctctgggatgttagtgtgtaaattgggcagtaagattccatgtgtattagaaataaacttaattatttaggaggtagggtggacctcttcttacaaaattatattttctaaaagaaaataaaagcctatgagctatcaacagacatattgttgtaacaacataaaaagtacatctttagccagctttcactcatccaggctagtgcaaataaggtgtctattaagaaatggacaggtcatgctcaaaccttccacgaggctgtggtcccatctcatccctttctcactctgacaggggcacagtgaacttcctagtccattccatgtcctgcccagctcagggtggaggagccaaagagccctgctgtgaccacccaggagggagagagggaagggcttggttcctccacgctgcccaagcctggtctgtctcagagggcagggctgaggaccagagcgcctgtgggccagatctggagcagctggcgggagtgaatgacctgtgattctgcgtcctccctctactgtggtttcctgtctctgaaaccttatttctctcagcatcctgactataattaacatatgaaaaaaagaagccaaataaatcaagagaggctgaagcccttcgcatttaaaatccatccaccatcgtttcccccattttatcagctgtgcatgtgctgagatggattatgcattgacactgtctttgaatagagggtgagttgggatcctggtaaagcagccattagaccattaaaggcagtaggagagatgcaggaagtgccaggatcactagaatctggggtccctaatccacacaacctcacccagccttacaacaagtcctgtcaccctgaactgcccaggcttacagagtaccttcaaagatgtgaaggggcagcttatctttcaaggtaaccaaaatatcatcttgatattaaatcagattacttggctaattcatcagtttccctcagagttaggtaccctgcacatgtcgttgtcacctttagatggcctcatgcatgggaatgtgaattattcataggctttctttgggttgcaggaaaccttcatattgctttagtttcttaatgtatttgataggctctttgtgtatgatcacattatatgggtattgctggcagtacagtaaattttaaattatatagtctgcagctttgcactaagacatggtaggagatgattcatcattttccttgtcttcctgtttacatgcggacatataattcatgctcagaaactatctttcagctcatctggaagtgctccactgcaccaccacagaatctatctctgccagtccagaattgtaaatcacttttctattaaacagcggggctaaaaatgcaaacatatgtactttaaatatatgtagccatctccaattcccagaagatgagccaaaattaaaggatagtcaaaaaagctagtgctagaatttaatgaatgaatgatttgacttgagatcagaaatttgcatttctgtacacatattgaagatatatatacacacacaggtttcccagaatgggcctgtctttgggaactgtgtattctgcagattttgtacactgaatctctatcattctgaaattttacttcctaagattattcactcatgcagagtcacaagacagacttgatggtggggagaaaaggtctgtataaattctcagtttagcatgatatgaagcccttgtctgccatcctcttgaccttcatccccaggccaagacaatgaagtcatttgctcaggatgatggacatctagactcagtagtgagtgcttttcatctccaaggataagattccacccagcaaatctgcctactcaggcagtagtgggagttagatatttcagaaaggttttcagcagtcactgtttctttgcccaacaatacacatcatcatggttctctactccctgaacctgattcagctgtgatagtggataaccattttcacacacatgctcatgaacatctggcattgttgaagaaggaagacctttccgggtaactgaagcttacccattgaagagttttttgtttaatattgcagctgtcttaatggaatccttctgaactgtattatttgcttgcctactttttttttttctttgagacggagtctcccactatcgttctgttgcccaggctggtgtgcagtggcatgatcttggctcctgcaacctccacctcctgggttcaagtgattctcctgcctcagcctcccaagtagctgggattacaggtgcctgccaccacacctggctaattttttgtgtttttagtagagacatggtttcaccatgttggccaggctggtctcgaactcctgacctcaagtgatctgcctgcctcggcctcccaaagtgctgggattgcagttgtgagccactgtgctcagcctgcttgcctactttattaagcaaaggctgccaaaccatttcatttgtgattctgtgattctgccgagaattgtggtggctgtctgtccctgtagaccattggttgccttgccttggagctcacagcctttcacctgtgctttatattcttgtacatttcaagaactagagttccaaaatccggtttgctagacttgtgctatggtttaaatgtatgttctccctcaaaatgcctatgttggcacttaaaccctaatgtgatagtatcaagagatgggtcctttgcggaagtaattaagtcctgagggctctgccatccttaatgggattaagccccttataaaaggggcttcagagagctgcctggccctttctgctcttccattccttctgtcatgtgaggacacagtaagaaaacaccttagctaatgaacataggaacataaaaccaaacacctcacttataagtgggagataagtgatgtgaactcaggacacaaaaaaagatacaatagaccctgagacctagctaactggggaaggtgggaggagagagaggagcagagaaagcaactattgggcattagacttagtacctgggtgatgaaataatctgcaccacaacctccctgtgacatggatgtacctttataacaaacctgcccatgtgccccgagcctaaattaaaagttaaataaataaaataaaatgccactgggaagcagaaagcagccctcaccagatgccacatctcgtaagacatggagactgttggcacctggatcttggaattccagcctccagaactgtgaaaaaatacattcctgttttttctaaagtacccagtttcaggtatgttgttatagcagcatgaatggactaagacaactcatatgataagctgggctgccaagtcctgcagaaatacctgtgtcctcttcctgcacagtacaggtcagggctttcacgaacaagttttgctgtggctcttctggagttccaggggcccttctgtgagtgggttttggggggctgctttcttccttatttcatggtagtcttgaattagtgataaacagagtttgaccatatgtgtggataacatgtacaggtcttgattgaaactcaagtttgaagagcgtttgctgggtgccaggcataaaaacggggttcctgcttgtattaggcctcaccctcgttatttaattacccactaaaggcctcttaacaaagtcactctggccattaggtttccttttattgttattgttttaagacagagtctcgttctatcacccaggctggagtgcagtggtacgacctcggctcactgcaacttccaccccccgggttcaagcaattctcctgcctcagcctcccaagtagatggaactataggtgcctgccaccatgcccagctaatttttgtatttttattagaggtggggtttcaccatgttggccaggctggtctcaaactcctgacctcaaatgatccacccacttcggcctcccaaagtgctgggattacaggcatgagccactgcacccagcctaccactgtgctcgaccctcattaggtttcaatatatgaatctggggggcatcagaccctagcacagcttctcacatagcccctctcctccccacccagcctctcttcttcctttattacttctgttaagtgcagcctattcattggttgaccttttcagtcctataactcagtggcttagttttttaacaataaatcacaggaaggtggcttaactattgaaaattttattaaaatggttataataatgacttcattactctctgaggcttccagatcttctcttcattccagggaagctggctatgtgaaggcatctgagaattgctattaacctctgctgaattaaaaacaggagcggatgaacaatgttggaagtgggccgagggcttttcagagataatagttgtatgatagcacccccagtttaaatataacacttttgcattataaaaaaggcatattaattcatggtaaattgaaaatttaatttaattttctctagatgagtgaggaaaaaaaaaatgaagactccttactctgcttgattcagttaccatggggatagaacatcttttcgggagaacctctgtgacatggcacatgagccctcaccttctgcttcacatgcctggttttgtcgcccacttgctcttcctgatgaatctgccccagcatccaaatagcacaaacccatgaatattctgtaacccattttcatctttgagcctttgctcctaatctgttacctttgacccctatcctcccagccacccaaattgagcatatcttccaatgcacaactcaagtcccaccgcctctgtgctttctctaactccacagccacacacagcctgtcctctggccttcctcaggtcctaacagttgaggtgggcataaaagaaatgagcagatgaaaataatctgctttgtagccaggcgcagtggctcacgcctgtaatcccagcactttgggaggccgaggtgggcggatcacctgaggtcaggagttcgagactagcctgaccaacatggagaaaccccatctctactaaaaatacaaaattagccgggcgtggtggcgcacgcctgtaatcccagctactcaggaggctgaggcaggagaatcaattgaacccgggaggtggaggttgcagtgagccgagatcacaccattgtactccagcctgggcaacaagagtgaaactctgtctcaaaaataaataaaataaaataaaataaattaaataatctgctttgcaacagacagaactctttcagtaaaatatccagatccggaagctcatttcctgcatattttgtctgcctgatgagcccctcctcatgtacctgcatctctttggtgatcagtcttcaaggcatggggtggaaccaccagtgctcagtctggaactccaatggtgtgattggcaggagcagagatgccacagcctttcaggtcatgggaaggctttttggtggttgttggtgttcttcatgtaggaccctgacaccccttccgtaaatgtaattattgttaaaatgataatccttgagataatggaaagcaacccagtgaggctgtggaacctgcattgaaaattgttgaggtagaacagactgctacaggtgagagagtcttggtttccactcctgtcggcatttggcatttttgcatgtacaaagtctgttccccatcccatgacaaaccccaggtgaatcactggacataaagatggtatggccaaggagaagcaaaacattgcagaccgtctctaccagcagaagctcagcaccagggtgcaactcagatgacagattgtaggtaaacacgtgtgcttactacccattcattcattattcattcatccattaacacgttttgcaaatattctttaagcatccattgagtgctaggcaccagggatttgatgatgggcaaatatagaactaatgatacccagtcagagagagagataagaatcaagtgtaactacataagcaaatgtaaaaatgtaatggggacacactctctgaaacctaggagttggtgggagatgctggtaacagcctctgatagtggggtgtaagccagcaagatcagccaagccccctgaggctctgagatcaaattgaaatccgaaggatgagtagaagatgaagaatggtgaaaagaatgttagaatattctaggcagaaacatgtggccaagtcctgttgggcgggggcagatgagaggaaggaagaggtgggagatgtccctagtcctgcagggcgtggtgtgccacatcttcctagaagcaacgggaacccatggagaggctcttggggtgagggtagagtgaggacaacttcacatttgcacacagggaaaatcctcttctcttcagagtggagaataggcaggaggggagtgagcatggaggtgaatagaacactcagaggccactgtggcccagccggggaaacatgacctgaccattccctgggaagacactgtggcccaggaggacacacacactgtcactgggaggacactgtggcccagacagggacacacagcctgactgttcctaggagaacactgtggcccaggaggagacacacagcctgactatccctgggaggacactgcagcccaggaggggacacacagcctgatcattccctgggaggacactgtggcccaggcagagacacaggcagcctgaaccatgatggtgatggttgagtggagagaaatggacaacgttaagagatactatgatgtaaaatccatgtgtgagccaggagaatagcttcaacttggaggcggacattgcagtgagctgagattgcgccactgcactccagcctgggtgacagagtgagactctgtctcaaaaatataaaaaaatcaaataatacaataaaataaaatccatgtggcaaggtgacccactgattttgggttgttaggaaaagagaggtatcaaggatgactgctaagttctgtgctctggataaaaatgaaactcaactttgaggaaactgtgtactctaaatgtttctgcattggtctcccaggccattccaatcaactgcaaagcttcatctttcataaaacatgaccttaaatgaagacttaactatattctaaagtttgctgtgtacattaaataccatatgtggtgaacatttccaaattccttaactgtgtgacacttcatttgtttttggtttcaaaatggaaatcacaactgtccccaatgtatagagttagattttaaaatttaccaatactaggcaattgcacaaaagatttctagtaatgtccacaggaaattaacatcagcaacacaatttgatgacgtaagagggcttttgcaacatatgatcagttccttcattgttaacattttaaaaacattctgatatcagggctgggcatggtggcttatgcctgtaatcccagcactttgggaggcagaggcgggcagattacttgaggccaggagtttgagaccaacctggccaacatggtgaaccccgtctctactgaaaatacaaaaattagccaggcatggtggcacatacctatgatttcagctacgcaggaggctgaggcaggagaattgcttgaacctgggaggtgaaggttgcagtgagccgagactgtgccactgcactccagcctgggtgacagagtgagactctgtctcaaaataaataaataagtaaataaaaataaataaataaaaacatactgatttcagagtaagcatatcatacacaagaaattacctttatacctcgaatcccttttgatttttagaaaaataagctcagaaaatatgcacttttcttagaatagtctgcaaaaatttaagaagataagagttttctttcagaagacattatacagcctatatattttaaaatagaatatatatctatagaacaggtacatgattttgagcaaatcatgttacctctcttgaccttgccttctttcacaatggatactccaattacgtgttatccaggttcgttttggcttttacgattgtttaattctactttttcaatcccacttcctttacccagtaataatattcattggtgtttttcccttaatcgaagaaaaaaaatgagaaaaaaaaatctcattggtttgggagtctactctgtgacaggctttgagcatgtgtatatatcttattagtaatctcagcacctgtaacacttgtgtagggaatgtttcattttacctattctatcgataaatagcctgatatttaaagaacagagacatttactaacttttctaaagttactggaggcaggatgtaaacatacgaatttctggcttcaaaaccaaaattcttttcctgggtcattagaatcccccatctaccaatacactagtgcccaccctctctctgtggagtcagtaatactttaacttcgtatagcaagcaatgcttcaaagcaacctcacagttttggtcccactaccccttaaaattggaaggcaattcatgttacccacttttgatgaatgagcaactgaagatgatccagcagcagccaccaagtggctgagacacaactagaaccttgtctctctattaaatgcatttcctgatgacacgatgctgaaccttgagactcacaggagattaggcccatggagaagtgggaggaagaggaacaggggaggagaaaccatggccagagttctggggctgaaggaagatgagagggaaggtggagtcctcaccaaatggcatcatgtctgcaaggtgctctttcagaaattccagtaagatccaaaagcatcttgccaatgaaactagaaaccatttgataggttcgatctggacaatttttgtcttatgccagatgtgagttgatgaatgtcaaatgatagtttcagatgtaaacagcagggttcctgaccacagcagaagagcagagaaaggaaggaacccttcagctcacagaatgtgaaaggcatcagtaaataggggagcatcagtgcccatcactgtcaagggattactccaagacacagggattcttcggggggcctttctaatgtcttaacatttaatagaattgaagtgtctttcttcgtacagtattgcaatccatgtagtatgggaactttatcaaactccagaatatgtgacagtggacatgtgatcctattaccaattttttcaggatcgactctacatgggcatcctcagtaggctctgctgtcaaaaatccataattaatgctgttttaacaagtgtcaaggcaaatgtggccatttgtagagaggaataattatttgcttatttttggtggtatgtgatcttcagagtcagagaaagatggggcttacagtcaggtgtcaattgtcagtaacgtgcccttgacttccaggaagttccttatctccttgaatctctcttttacacctagtgaatgggatgacagtttccttcaaccagtttcaaggatccagtcagataatagatggtaaagtgagccctgtgctattggtggcaatgtaaaatggtgcagctgctacagaaaactgtacagagttccgtcaaaaaatcaaaaatagattacaatatgttccaataattccacttctgggtatttctccaagagaagtgaaattatgatgtcaaagagatatctgtactcctaggtttgctgtagcactattcacaatagctgagatgtggagaccacctaaaagtccattgacagatgagtggataaagaaaatgagggacacacacacacacacccctaggaatattaatgggtgttaaaaaaagaaggaaattccgccatatgctacaacaaggatgaacctagaggacattatactaagtgaaataagccaatcacagaaagacagatatgacatgattccacttagatgagagcggaatggtggttgccagggggttgggagaagggaaagtggggagttgctcttcagtgggctgtggttataaagtttgttattgcaaaatgaataaattctaaaaatctgttgtataacattgtgaatatagttaacagtattgaacagtcactgaaaattttaagatagtagatctcatgttatctgtttatatcacaataataatattaataataacaaaagtttcaagcaccatggcagatgtatctaagaggtcttcctcctctcaccctgcccctcactctgctcctctcccctacactgttgacatcctcctggactttactcagcctgcttcacaaggacaggttcagggtgggtaagacttatttggggagattgtcattcaaaactgaaggagtactgagtgccagacactgtcatgatcagagggtggaaacccctgctatttgaatggatcatcaggcaaaatgaggaagtgtcaggaattgccctatgcctgccttttatcctatgattcagagctctcattcactaaagctacaatttatttaacctgctcagaaatttcaggaggaaaatcagtggatgagaaatcaataataatgaataatctcccattcagaaatatcattagagattatttttcattattccactggtaacagcaaatttaaaagatactgttataaactccatagcccaagcttaatagaattaataatcaaatgggatcctgagatcaataattctcaaattgttttttgtactccaggaattcccagtgtgtacttcaaagtgaatctgacacttcattttaaaaacaatttggagtgacttttgtccctatgaatgatgccaaattgatagtttaaaaattgatgggtttaacccaacaatgaagagactgcaactaatcagtccattctttccttctgcaagggtccttggctcatcaaaccatctcgaagtcctcatttaactaattttattacttgatctacaatttatttcaccccagccacaaaatagaccagtacttagggataaaagtagctgacacaaattttgtttcaaataggtcattattttatcttgatatataaatgtcaaagataccgcttgggttcaaatggtgccagaagacagacaaatgggcaggctatcagagagaaatggaaactgggaaagaatctatttctcttcattttagtaagaacctaagatattgtcctaagcttacaattgcagggacagaaggagaatctgaattagcattaaaaatgattttttaataatatatataagggaacttttaaagttcatggaaaagtggacttaaaagataaaattaaaaacattaactttatttctcagtataagctccatcaagttcaaaacactttttaaagcaatgatgtcagtcatttagtccatccctaaagaactgagggtccctggaatttagccatttcaatgtaaccttttttacattattaactgaagaaaaataggtgccctttacagattttgtaagattaggaaacaaaaagaggtcaaatggagccaaatcagtatggtaaggtgaatgcctaatgattttccattaaaactctcacaaaattgcccttgtttgatgagaggagtgagtaggagcattgtcctggtggagaagcactctgtggtgaaggtttcttgggcgttttttttctgctaaagctttggctctctcataataacacattatagttatttggccctccagaaagccaacaagcaaaatgccttgagcatcccaaaaaacttgctcttgattggtccacttttgctctgactggaccacttccacctcttggtagccattgctaaggttgtactttgtgttcaggatggtactggtaaagacatatttcctctcctattgcaattctttgaggaaatgcttcaggatcttgaccctatttgttgaaaatttccattgaaagctctgctcttgtctgcagctaatctgagtgcaagggttttggcacccattgagtggaatgtttattcaactttaatttttccaccagaagttgaagcaattgagatagctatagtgttggcttttgtttttgctgttaattattggtcctcttcacttagagcatgaacaagatgatgtttttcctcacaaattgatgtggatggattaccactgagggcttcatcttcagcatcatcttgtctcctattaaaacaagtttttttatttgtaaactcctgatttttgaggggcatttcttccataaactttttataaagcatcaattattacaccattcttccgtccaagcttcaccataaatttgatgtttgttcttgctgcaattttatcagaattcatgttgctctgatggaggcttttttttcaaactgaggtcttatcttttttaatgcatcaaactagatcctgttcagacatgttataacaaattagtacaagcttatttggtgcaaaatattttgtgaaacccatgcatagttggtttttataatacacattttttcatgaactttttgaagaacttacatataatatttcaatagtggtttatatatattttaaaatgttttagccttataaaaagattagagaaaaaatatttctggtttgggaattgaacatcataaaggaaagttagagtttgcaagatctgaactggccacctgagaagcagctacattatccacatttccttctctgcaccctcctccgcaccctcctccaacccctccctcctatcctctccccatcctcccacacagatatggatctgatggtatgcacgaagcacatggaaaattctgtggaaagacaagaggaataagctatggcccccactcttaataggaagtaggtaaagatttgctctgcaaggaatgataatcaacaaactatttctcagttcttaaaaagaagagataagctagaccttgattagatgcagagaactgtcattagagatgagtttctcttgccttctttccccctgttgctgtgacttcttcatctttaagggactgatgcagcttcatttccacgtgggtcttgtgcctttggattccagctaaaagctcctcccagctgtgaacctgggtcatagcccatgagagccacaagggacttgagtgtcttctggttcaaccacctcattttacagttgaggggctggtgaagggactttcccagtgtccccctgagttagatgtaaagattggggctagcccaaaagctgtctgagcctcagccatctgtcactcattcctggtgcttctctcacctcctcaccaaaagacaaacactgtggtttatccaaaagtggccttgcagattttctgattcatgtctttttgccactcaaaaacattgactgaatgagccctgagtgccggatactgttctaacctatagactactgtgtgaagagtagaattaaagtaaaacaaagacaattataacataaaatcagtccaaactattctacctgtaagtgcataaaatgataatatgcatttttgcatcactgtaaagaaaagtatttcatgtcaccagttccattcagagcactgtaattggcaattacttatttttgacatttgtaagacttcttgaaagatagaatttgaatgctgcatctagtgactgattcttcttgcatattgagctgtttcattattttctactctgctttaaacttgaatcagtatagaaccctcccacattcttgacagggtcctctttactcaagatcttgggatcacaggtttgatctggatcaccctgtctcgtatcttggaaatgatgtctttgacatggatagagatggctagcatgactttgatttgttgtctgtgcctttccttgtggcatgagaggaggctgagaaatactgggctattgtgaatgggaaatgagagttcttacaggcacgctgagcatcccagttttgggcattcagtccaagttttgtgtgaggacatcaggagcctccctaggaatacgagtacttccttcagtgcatcaggcagtatgattagaaccacgatgtaagtgtcaggataacatcgggcatgagagtctgttgctgggtctaatagcataaaacaggaggtggtcacagcaagtataagcactgggaggtgtcggcatggaataataatactggtgcaaggagtgggcttaacatcataactgggaacccagaagccagcaaaatgcaaatcagacaggcaggcagcttctgtctcccttctgtgtctctatgcctgcagtgaagactacctgttgtctctctcctggagcacttgcgagccacagatgagagaggacctttcagtgactgattacagcctaaaggctccaggaaacagccaccactgcgggcttcccccacgtgcttctctgaaaggttgtcagcagtgtattgatgattttcaagtatttgagcatacttgtagcccttgaggtcaaccggcttccttggagatggccattctactctaccagccagggaggaactgtccatggtgctgcttcgcatccagaggctacagggttgccgtgtgataggagccacctgggcagggacttaccctcaaacagcctcgtgtttcatggtgcagcactacagggacaaatgcttacctttgggccagtggagagcaatagcaatcaggacttgggagggaacctaagaggataggacaagctgatagggtgagtggggtgaggtgagatgacaaaggggcaggtactgaacaaaatcaggctatctaacaggcaggcatgctctttaatgggtagggtactatccagtcaagtgtaggccaagaaacagcaatcaagattccttggcccagaaacagggtgtcccagcaaacacaagagcccagaaacagggactctgcaggtaggcacatttggaagctcagggaggcagacttctcctctggagtgatcatctactgatagcaaaatcctagtcaccagggagggctttggtgtcaggacctcaatccctggaaagtagataagtaccatcagaacaagaaactctgtctggattggaatggtgttaagggcatcttgatatgttattcctgcttaagtgactcttaccttccatgaggttggttgtgaatcctagaggctgtgtatggagaaccaatggccctgttagaaagggtggacactgggcagctcatcccacattcagaccctttgcagcaggtctccatgttagcatgttctattttgacaaagccttttgtcctgccaggcatttaatggacttcacacattctacctgcggagctcacatcagggtatctatatctgttcctctagctatatttgtgtttgtatcttgatgctgccaagcatagggaaggcagggagaagccaaaagtcagcagaaaacagctgagataaatgacatacaatgcgggaggaacgcagatggaaatagatggcatgggagtttgaagaagcaaggagccacgaagtgctaaagtctgcaaggaggttctcaagctcatctcactatttatatcacagattacagatttcctgctcgtgtcaaaaataagtcattgccagttgctgtgttttgaagaaagaatcatgcttaaaattatttcacttagaagctcacaaatgaaactgttgactctaaggaataaactgtgtagatagtaagtcttaccagctgtgaattagagtagtttgtgagagtcgaattcagacattttcttttttgagaaaagctggaatagaaagggaagcacttctgccaaggttaacagtaggatgtctttataaattcgatgtagctgtgagggaagggacttctgcaagctttcgtgcatttgctcattcaataataatctgttcatcagtgcagtgacacaaaatatttacagaacacagcatcagtggctaaggagcttataagcaaatgaaatgttaggtgtgttatgtgtgggttaaatggtgcccacccgaaattcatatgttgaagtcctaacccccggtgactgtatttgactaggggtctttaccaaggtaatcaagttaaaatgaggtcattagggtgggtccaatctaatatgactggtgtccttatgaaaagaggaaatttggacacagacacccacagggagaatgccatgtgagatggaggcagagatcatggtgctgttccgacaagccaaggggcaccagagattaccagcaaacccaccaaaaacttggagaagggcataggacagattctcttacacagcctcagaagaaaccaaccctgatgacaccttgatctcagacgtcttgtctccagaaccatgagatgataacttttctgttgtttaagccacctgatctgtaggactttgttacagcagccctagtaaacaaatactttagaaaaagtaaaaagagaagcgaagcaaaacttgcatgcacaacaggtatgatgatgctcatgactacagacagtgagaaaggctgtgggttggattactctggctcagcctcatagaaaaattgaggtgaatgtttaattgagtgtggggttggtctgaagagaaagaatagaaaaggagaatcatatttcatacccttactattcagtcagctatggaaagcatatttggggtggctagaagatgccaagtacagtgctaggtgatgaagcagtgaattaagttaggacaatgtggcccatgtagcctctcaacaggaaggcaggttcagatagaggaaacagcaggaaaaaggtgacaacttgaaaatgagtctcttcctcattcaggtagctttggtgctttgcccactggttgtataagagaatcctgggaaacagcctatgagtagtatttgatatcttgggatgtgggaggtaatcagatttcagtgatgataagacactcccatctctgagctgggtgtttcccagaaaattccaaggacaactggcctttaacatctctctctatggttaacttgctaaacattatccagaaatagccagcaccaacatctccttcaggaccccaacagccaggcattttctccgtagactttgctccaagcctcttatttctgggtttggatcctacctttggacttgaggggcttagatattatcacttaggtggacaaaccatccagttaaacacacacacccacacatacccaacacacacacagacacacacatacacagaatcaacactcaacacgcaaacacccaacacacacatgcacacacactttctgaagatgagttttctcatttatgaaatgagctcatctggacttgccatgagggtccaacaggtgccatgcaatcaggtgtgcactcagtatgggctgggtggagatggccatctcctttcccgtccaggcctggttcctgtgtgctgggcctctgctcttcccacctcacacagcccctgcatggaacagagccggccctgggaggcctgggatccccgtgcctcccttcagcccctcttccaaaatcttgataccggacacacaaaggacacagcagatggccattgtatgatgggttttgttctgttttgttttggtgacagctttattgagatgtagtttttaccatacaatttacccatttaaagcatacaattaaacgttgtttagcctatgcacagaattgtgtaatcatcaccacaatcgattttaggacatttttatcacccccgaaggaaactgtgccccttagcagtcactctgcatcctctgtccccaacccctggcacccaggcatctgtgatcactctgtggatgcacctgttctggtcagctcatccacatggtatcatatcgtgtgtgttttcttcatctgacttcttccctgagcgtcatgttttcaaggctcatccaggtggtagcctgtgacagtgcttcatgcctttctattgtcaaataacgacacagtgttttacaacccctttccacataggttagtatcaccagtgtgcttggatgaattgcagtttgcccagtttgctgttccaaaagctagagaattcctttttttcttttttcctcttactatacaaaccaactctaagtgataattaaaagcgtgagctttgaatttaatcagcactttgttcctttctattgtcaaataactacacagtgttttaaagcccctttccacataggttagtatcaccagtgtgcttggatggattgcgatttgcccagtttgctgttccaaaagctagaatccctgtttttctttttttccccttactgcacaaaccaactcgaagtgataattaaaagtgtgagctttgaatttaatctgcctagattcaaaatttgccatgccatttcttaggtgtattacctgggcaactactaacaccttgttacctcagttttcttatctttattttatttatttatttattttgagacaaagtctcaccctgttgcccaggctggagtgcggtggtgcaatcttggctcactacagcctctgtctcccgggtttaagagattctcttgcctcagtctcccagctatctgggattatgtgcgtgcgccactactcccggctaatttttgtatttgtaataaagatggggtttcaccatgttggccaggctggtctggaattcctgacgtcaggtgatctgcctgccttggcctcccaaagtgctgggattacagatgtgagccactgtgtccagccagttttattatctttaaaatgagattaataataataccaaacctaataggaatgttgttaaatttaataatttggtaagccattaaatcacatgaaactatacctggtacattttaaacacccttaaaagctaaatattatatatcatattctgctttttaatataaataggtcacacaatatatcagcatgcctatagaggcatttcatccttaatgttacttaacacttcaatttattacgaacctaaatggccagaaagctcaggtaaacaatttcccctataattttacgcaacaaaaattgggatttataccaatgatctcaaagtagtttaaattcttaggataatttcttagcccctgatgaaagattctcttcattcttttgaatgatcagtgtaattgtacttctagggaagatatagccgtttatttctcactaaaccatgacctgtgcatgggtgaggcagcccacagtgagcctgaatgtttggccaatccattccttatgtggactcatggaaagcctcagcctataatcagatttaaagaaatctgtagccatatgtgtttccctgacgtcggtattgctgggccatattaaattgctttacatccctaataactttgctttctattgttctctattctgctgcacttacacaaaagctccatggcagagaaattggaaagaccagtaaaaaaataaggaaacaggatattgtgtgtcctggagggtttccccggtgctccccagcctccattgcacaacctccctccacacagccccgccccatcacaatttccaacccctttactcaccccctgtgtctcatccactttcctctctgtcaaaacccacacttagacattctcagagtccttcccattgaggtccaaacaactagtgatggtttaaaatcttacgactgggcgtgagggaaggcccataccttgagataaagctaatttgaagctgatggcaggatttccaacagcagccagaggaggggcagagtttaggggcagtgttttgtcctatagtccttaaacctgccttggatgtggctggttctgacatcttgaataatcccttagtatcttgtttacaggtgatgacacaaacaagttatctggaaataaaatgaagggggaatgaaccaaaccactttaaggtagctacttttaacagttttagggggtcagttcaaaagtctttataactaaattctgaaatacagagtgccctgttttcaccttcaggggtctgacacccagtgttaggtttacagtgtgctgtgggccattcatctgggccccaatgagcttagaaaacaactaagtgaacagcagatcctcagccaggtgcctggccccctgttgacctcacctggggtctcattcactgtcccaccttccctggaccaggcttccccctccactgtccacttaccaaagagtcacaccatttcatctagaaaccctcatctccttcttctttttttctcttttccttctcctccttccagctcctaaaatagaaattaatgtagtcctggcccagcagatgcttcagggatctgcattctgttcctaaatgctcagatactcactaaagacaaatagaagtgttgggtccacagtggatgatccctcagtacatcttgaaataataccttgttaaagaaagaaggtcatatccctgctgaggggagccctgggagcgtgtaagtccatctctgggcagggaagctgaccagagatgcagctgttgacatgcagagagaatgagatgtctgaggacaccctctgccagctcgtgtctgagagaggatcccagggacgtgctggtactgagtttcccctctaagcagaagggaacacttcagattccaggaggacatcgaagatgtctaacggatccttttcctcaccaaagagatgtgttatttggtatttttaataacaccatctgccagtgagaggaaagctccgaattgcaatattgatcttgtcactttggggaacagtttgatatttgggattataaataacattttcatttgctctgttatcatgctcaggcagtgtttgatggctgagcccaagaatattattttcttatcaaatataaagatacgtacttttcctgaggtctgaactctgggttgtgaaataatattgacacatattaaagagtaagatgtattctgaaaccttaacaattcagaaggggtgtaaaatttttctccttaaaaatgaaatcgaggacaatatgaggtgataatagcaataactggctagcgtggattaagaggttaagtcagagtcggattagactgtctgatttaagtaacacgatagcctaacaaggaagcacagcagcactattgttcccatgattcagaccagcaaaccaagatagccactgccacggggctaggaagtagcagagctgggatttgaactcaagcacactggttccagagtccacgctgtgaatcattatactctgtctttatttgcacctacatgggaatggattctcttattattatgctatagataccttcaatatttctttctacatttaaaactattctctcttgatcctcatgaaaattatttgagatacacaggacaaatactactatcccagttttacaagttaaaaacccaaggcccagagacattaaacgattttcctcaatgccatattggaagttaacaacagatcgggcttcaaatataaatcacctcactcaaatacatgtatctctttgatttgagcaacacaaaattattaccattattgtcattattgaaagaaacagttgatccatttgaaagataagctacactgtttgtgcttctgggtggctgggatggtaaaggaaatgcatgtggaggcgtagccagcattttgctagcaagctccacaagaatgttttacctaagttcttaggggaaggggaaaatggtcagggccaattctttcatggtaccgagcttcagacactttctgtccaccatttgtactccctctgatttcccgtatggaattgaggtcttgcattttcaagaaaaatggcaaaacaactccaaaaacatgtctttctagtgtcgtagctcttagtagcttccttatacagttgacccttgaacaacacgggtttgaacggagcagttccacttatatgtggattttcttctgcctctgccacccctgaaacagcaagaccagcccttcctcttcctcctcctcatcctactcaacatgaagatgaggaggataaagatctttatggtgacccacttccacttaatgaataatattttctcttccttaggattttttaataacatttctttcctctagcagtcactttattgtaagatcactttattgtaagatcacagtatacatacacagaaaatgtgtgttcatcgactgtttatatcattggtaaggcttcctgtcagcagtaggctattactagttatgttgtggtgaatcaaaagttacacaagggctgggctgggctcaatggctcatgcctgtaatcccaacagtttgggaggccaaggcaggtggatcacttgaagtcaggagtttgagaccagcctggccaacatggtaaaatcctgtctctactaaaactacaaaaaaaaaaaaaaaagaaaaagaaaagccaggcatggtgtttcacacctgtaatcctagctactgaggtggctgaggcaggagaatcacttgaacccaggaggcggaggttgcagtaagccaagatcgtgccactgcactccagcctgggagacagagtaagatgctgtctttaaaaaaaaaaaaaaaaaaaaaaaaaaaaaaaaaaaaaaaaaaaaaagtgatacaaggattttcagctgctcggaggttcaaggttcaataccttaaacttttgcattgttcaagaactaattgtctatgaattttgtaaaattgttcagagttgtaattattatctttgttgtaggttttaaggaaaaggatcaactcttcgttattttcatctctgtatttagctaagtttatgtccaatggggtaattctaaccatattttaagatactgccagcgtagattgtctctgttaccaccggatgcctctggagaatgctgcatgcatcaaaatcaagcagtaaggatgaaaaaatctgctctttcctgaactgaccagccttccctgactgtgcacactgattttatctcaatacagtccacaggcttttgtctttctatgagcttttccttctataataagaataggaatagaaaatgaccactaagttctccatcttccatcccatgcctcagccaaggcaagaaagagtgaaataactgctaagctattataaataactatctcctgtaaaatcatgaacatagagtgtatgtcagagatgttggaatcctgcatccttaatgtttaatggtgtttcctacaaatgttccctgagtattcccagtttggtgatatagtccaagctgcagagggaaaggatgtaacctgatattcatattcagttttccacctgatttctttggggattcacctcatttcctcaagtcctgctaatgtgtacggtggtaattccagcattctctcctcggaatatcaacaatgacagtttcttaattgctctcagtggattttatgtaggatagacagtgaggtttgaccacttgattcatttgaaatgagcaatacttccaccttgacatgatatcatatacttggtattttcatgatttattggtggcctggaccaatatactttgggtcaaaaggtgtgatttaaggaattcaacctaagaatagtaggccagctcattctcagtcattatgtgatttgttggaatattgtgaagttccgttgataaataaattgatgaaaaccttttttcttaccatgtaaccacatactgctttgcaccaatgattgggcacaaatataaacatattgctgcacagtaggtaattcaatatcaatatgtgtgtgtgtgtgtgtgtgtgtgtgtgtgtgtgtatatatatatagagagagagagagacacttttatccatttaggaagacaaacatattcataactatgttttccattaaagtatgttttccattaaaatgtactaaataggagagtaccttcctgtgtttccctgttttatccaaattctcagtgtttttaaagatcccattctggcaggtcatggtgactcacacctggcgtggaggtgagcacctgtagtcctggctatttgggaggcggaggcaggagaatcgcttgaacccaggagaaggaggttgcagtgagttgtggtcactccactgcactgcagcctgagtaacaaagtgagaccctgtctcaaaacaaaacaaaaaaaagatccaattccatccccatctactccaaaatgcctccctatttattcttatattgattaatgtattcttcctcaaaattatattactttctgactcaatatcatacaaaccggcacttatcacatcttgaaatttcccgaagctaacacgtgtctaacctgtttcccatattatgttttaagtttaaaaagattgtctgccgaccgaaaaagtttatgtcaaaactacagaaaagagccatttcttccatttctctaaaacatagccctgtgtcatctctgcttttccacccacccctaccccaacactcatcctacttaccttcctctggcattcacagagggctgagtttctagtagatgttaatcaaattctttgcatgtgattgctcagtctcttttaacttgaaaaggggaaggcagtgtaatagaacacaggaaggagctgttcataggttcagaagtcactcttggattttcaatatttgtgtttcattccttagaaagtgctgtcagttccctctttgaggagctctctgaaacaacaaagggacctgtcatttgtgcatacccccgactggcacctttgaaatgttatccagtcttgctacctaccatttctgatttgtctgacgttgacatgtacacaccctggagcaggtctgttgacttcactcaggcttatggaatattgcatacatccaccgtactccataaataactaatagtgtgaagcagagatcagatcaactgacagactttgtagaatgtaatctctggtaacactgactttaagaggcaatgagtgtgtgtgtgtgtgtgtatgtgtgtgagtatatatatattcccataggctagcaaatgaaaactgacagtgaacttttcctctagctctgatagagtgactggcattgggcatttcctcctggcataaacaactctaaagctggtaaaatgtgcatgacaaatgttttaaggcattaaacaacaggcagcacagaactgtaattcttgagagaaaggaaacatgagaggtgaggctcagtttgccccagtgctctgcctgggaccgtttcctgcacatctccagcagaactgtggcctcactgacctgaggaggagattggagctgtggtctcagaagcagctgagatttggggagccaagtgcaagagcagaagctgaggacaagggtttccagaagtcttgatgaagactcattgctggtttttggctgaaggctgcccacaccatggcaggcagtacacagggcctagcagtggttgccttctgcagggctgggaatgaatgaaggcattattgctatgcaccaccaggagatgctggagctccagctcagccagaatggagagaactcattgagcatctcagtcaggcattcagttgaaacctcagaaagtccacaccatagcagtaaaagctataccctcaaataagggccacaccttagcccataactagaataagttcatgtccatgaaaggaaagacatgaagcctggtatgaccaaaaagatcagttggtaatttccctgctgccaaaacaaaactcagagcacttctaatttaaaaagagattatctagaatcatgaaaacattttgtctatagtatccagaataaaatttttttaaaaaattgctagagtttcaaagaaacatgaatataagacccatgatcaaggaaaacaacagtcaatagaaacaagccctgagattaaatgcctttgatgttgaaattttcagacaaggattttaaggcagttataaatatagccaaggaattaaaggaaaacatggtcataatgagtaaacagagggaaagttgcagtagagaaattataactgtaaaaaataaaattttagaactgaaaatatgtagtagatgggtataataatagttaagaatggcagaagaggccggggcacagtggctcgtgcctgtaatcccagcactttgggaggccaaggtgggcagatcacgaggtcaggagattgagaccatcctggctaacacactgaaaccccgtctctactaaaagtacaaaaaattagccgggcatggtggcgggtgcctgtagtcccagctactcaggaggctgaggcaggagaatgatgtgaacccaggaggccagagcttgcagtgagccgagatcacgccactgcactccagcctgggcgacagtgcaagactccatctcaaaaaaaaaagaaaagagtggcagaagaaatgctagccaaactgcaggcagatcaagagaattatttgacctgaaaagcagagattaaaaaaaaaatcaaacaaaccgtatctcagtgaactagcaggacagcatccatgtggtcaaaatacatgtaagttgcgtctcaacaggacagaggagagaaaaaaattgtaaaataataaaacttttctaatatttagtgaaaaaaattaaaatgcttattttaaaatttcaagaaaccccactggtataaaaacaaagagaaccactcctatgccccaagataaccaaattactgaaaatctaacccaaagagaaaactgtcaaagcagttagagagaaaagacacgttatatacaaggaaacagttctaattaatagtggatttcttgtaagaagatgcagaataatattttagagtgccaaaagaagaaaaaaatacaaatctattgaccctaaattttatataaagcaaaaatatcctctactgtgggtaaaataaagacattttcagataagtgaaaaacaataaaattaagagtcagcagacctatactgcaagacatattcaaaagaagctttcagaggaaagaaaatgaaaccagaaaatgataattacagtatgacatgaaggataccaaaaatagtaaatatgctaataattagaaaatctatgtgtgtttgtttcttaattttcttgaagacacctgactgtaaaatgtatgacaataacaacatagaggatacaagtaactggaattaaactgttataaatgttttaagtttatgtaaattgatataatattgactgtatataaactatgagtaggtaaggatgcacattgtaatccctagagtaacaaattaaaaaataatgcaaagaggtatatctaaaaacctaataagggaattgaaaatggaaggataaaattctttgattatccccagagaaattagaacaagaggaatagagaaatagagattaaataggatacacagaaatatatgagtataggaaacttaaaactaaacttttcaataatttcactagatgcaaattaattaaacatccccagtgaataatcagttttagatttaaaaattgaagacataactgtatatctaaagggactttttttttttttttttgagttagggtcttgctctatcacccaggctggagtacaatggcacaatcttggctcaccacaacctctgcctcccaggttcaagtgattctcctgcctcagcctcccgagtagctgggcttacaggcatgcaccaccatgcccagctaatttttgtatttttttggtagagatggggtttcaacatgttggccaggctggtcttgaactcctgacctcaagtgatcctcccgcctcggcctcccaaattgctgagattacaggtgtgagccactgcaccaggcctacaagggactcactttaaatacagagacacagataggttgaaaaggaaagaatagtaaaagataaaccataaaacagtaagcataaaaaagctatggctggccaggcatggtggctcaggtctgcaatcccagcacttttggaggccgaggtgggtggatcacctgaggtcaggagtttgagacaagcctggccaacatggtgaaaccctgtctctactaaaaatacaaaaattagccaggcatggtggcgggtggcctataatcccagctacttgggaggctgaggcaggagaattgtttgaacctgggaggtggaggttgcagtgagctgagattgtgccactgcactccaggcctgggcaacaagagtaagactgtctcaaaaaaaaaaaaaaaaagctatggctatgttaatatcagaaaatgtagacttcgagataaggaatgctgttagaggaaaagagagatatctgataataataaaatggttaacttattagaaagatataaacatctatgtatatagtagctgagctttgaaatacctgaagtaaaaaactgacagaactcaataaattcgcagatatttggatattctaacattctcactcagtaactgttagaacaattaggcataatttcagtaagtatatagaataaagaacatagtcattgtgacttaattgacatttacagattactccaataattgcagaatatatatttttaaagtgcaagtagaactcacattatgttgacacataatataacaagtattaaatcttaaagattatgtcctttaaccacaagaaaattaaattagaaatccaaaacaataagatatttagaaaaagcataacatgtttagaaaataagcagtactctcctaactcatgggtcaaagaaagtacaggggtaagttaatacatattttaagctaaactgtaataaaagaacaatatgtcaaggctttctggatacagctaaagtagtgcttgttgagaaattaaagctttcattgtttaaatagggaaaaaaaggataaaatcaattatttaaattttttcttcaagaagttggaaaaagaaatacaaaacctctagaaagtagagaagaaaatgtgaaagaaaaaataaaatagaaaactgacaaataatggtgacaacttacataaatgaagagattcgatattatcaagatatcagttctccagcaattgatttatgggattaatacaaggtcaacgaaaattccaacaaggtggtagaaattgacaagcagattctaaaatttgcataggaattaagtgatcctagaatagctgaaacagtcttgaaaaaaagaacaaatttcaataacttccacaacctattttcaagatttactatgaagttacagcaataaagtgtggcattagcataagaaaagacaaataatcaacggaactcatttctgaagagtccagaattagacatacacatatacaaccattgatttttgataaagtaggaaggcctagatgaaattatggggaaaaatgaactttaacctctacctcacaataattaattttagatggatcatatatctaaatataaaagctaaaactaggaagcatgtggaagaaaataatggaaaatgttacaacttttgtgctggtaaagacttctcaagtagaaccgaaaaagttcctaccataaaaaaattgatcaattggactttatcaagataaaaatttctgctcatcaaaagacattgctaaaatgaatcatcaagggccaggtgcagtggctcacgcctgtaatcccagcattttggggggccgaggtcagcggatcatttgaggtcaggagtttgagaccagcctggccaacatggtgataccccatctctactaaaaatacaaagatgagccaggagtggtggtgtgtgcctgtagtttcagctacatgggaggctgaggcaggagaatcccttaaacctgggaggtggaggttgcagtgagccaagattgcagtactgcactccagcctgggcgacagagtgagactcagtctcaaaaaagaaaaagaatcgtcaagtaacatattagaaaaattatattcaattccatttgtgtgacaaaggacttgtatctacaatatataaatattcctacaaatcaataatttataatggacaaaagacttgaacaggcactttaccaaagaagatatctaaatggtcaataagcacatgaaatggtgcctaaaattattactcaccaggaaatgccagctaaaaccatactgagggaacattttaaaacccactggaatggttataatcaaaaaggttgacagcaccaaatattggcagggatgtaaaacaacacaaacgctcatacattcttggtgggagagagctctacaacaagtacaactacttggataattgtttgaaagtttcttctaaagcccagtatatagtgcccgactgcagtctactgcactcttaggtatttacccaacagcaatgaaaacatgtccatgaaaagacttgtacaggaaagtttatagcagccctactcataataccttcaaactagaaagaagccaggtatctttcaaccagataataaataattgtgatctattcatacagtgaactgttattgtgttagtcggtttgggctgctatataacaaagtgccatagactgggtggcttataaacaaaagaaatgtatttctcaccatttcgtaggctggaagttcgagaccagggtgtcagcatggttgggttctgatgagggccctctaccaggttgtaggctgccttctcacggtgttctcacatggcagaaagagggcaagagagctctctggggcccctttgtaagtgcactcatcccattcacaaaggctccccctccttgatctaacagctttcaaagaccccacctccaaataccatcacaatgggggttaggactttaacctaggaattttgatggggcacaaactttcagaccattaaagtgaacaagaaagaaggctgcgcttctaatacatgtcacagcagggatgagtcttagacgtgaatttcacacctggcatgaaggaagccaggcaaaaaggacgtgctctgtaattcagtatgtaagaagccccagagcagggagagaagtcagaacagtgattattatgggagggtgggggtggaattgacttgtcaggggaaatcacatacattgggaaatgagaaaatgtcttctgtcttaattggaatatatacatttgagggtatgcaccaaatgatcatgtatgtttgtcaaaagtcattgaattaggctgggcgccgtggctcacacctgtaatcccagcactttgggaggccgaggcaggtggatcacttgacatcaggagtctgagagcaatctggccaagatggggaaatcccatctctactaaaaatacaaaagctagccggatgtggtggtgtgcacctgtaattccagctactcaggaggctgcagcaggagaatcgtttgaacccaggagacggaggttgcagtgagccgagattgcgccactgcactccagcctcagcaacagagggagactccgtctcaggaaaaaaaaaaaagaaaaggcattgaactgtacatttaaaatctgtgcatttcaatgtatataaattttacttcaaggaaagaaaaaggggacatgtcttggcatgtgcctcctttcttaagcctattaattataaaactgggttacccagatcctagaatatggctatgaatagggtagctgtaagagccatagataagaatctggggacttacgggtgttgaaaactcacggtggggctgacaatgattataatctgcttttttgttaccatttcagattatgacaaagcactggtgttcatcaggaaactaatgggagtaaagggtaaatagcttagtcaaaaatgcagctctctctttcaacatattagcaggaggccattttctggttttgtgcgtcaagcacaaagacaagcatcctatttgtttttagaaatcacatctaactttctttaggaaaggaactttaattttatagcgaatgaaaaatatcaattaacctattaattaacccggagaaactattagcctgggagataataaaattgcttttgaaaagattacctgacaactgcacaaataattactcttgcaaacatccggtgttctgcctttctctctaagatacttgagagagtttaaatatcaaagaatcctgattatttcatgagtattttcttcagctgttataaaaatcatgcttcagtgtttcagggattttgttttgtgcttgtcttggcagtggggaggaggggagcttttgtgtgattccaggtaaaagtatgctactcacagccttttgtaggtcatggcttcttgagaatgtgtacaatgccacggagcctgtccccagatgcatttccatgtgactatacacatatgcacacaatcttgcatatgatttcagaagcttggtgggctgctagaattttgtctcagatcctctagagtctagatgatggaggctggatgtaagggaggagaccacccttcatactgtcttatgcccaatttctgcctccaaagaaagaagaagtaaaaactaaaaggcagaaatgaaatccacaggcagacagcctggtaccacacccggggcctggtagttaaaaatcaacccctgacctaatcggttatgttatctatagattacagacattgtgaaaatgcactgtgaaaatccctgtcctgttctgttccgttctaattaccggtgcatgcagcccccagtcacataccccctgcttgctcaattgatcacgaccctctcaagcggactcccttagagttgtgagcccttaaaagggacaggaattgctcactcgggagcttggtttttgagacgtgagtcttgctgatgctcccagccgaataaagcccttccttcttcaactcggtgtctgaggggttttgtctgtggctcgtcctgctacagatgggcagccttggttctcatttttcatgccatctcctctaatggaaacaggaatgatctccccatgtcaacacctgcagtgtgggcctgcatttgggagggcgtgtgggtgcgtgcgctggggctggctactggtgtgcattgcccagagagtttatctcagaagtctttgacaaaggcacggttggcttcattttctgtctgtgaattcaagtaggagacaaatggatttccttactttttctgatcctgtgtaggaactgtagaaaaatgggtgtttctccctagttagaaagaaatgcttttcccaaagatgaattcagacagctttatttaatggaaaaaaatgtcttgcctgtttctaaatgcattcttccctggtggcttatacctggcaaagagaaaaattagtctcttgactgaatgaagtccccgtcaagacgaaggaaaagagagaagtgagaaaagaggctagaagagccaggattgaaggcatcgtgctgggggtggggtgcgtgctgagggtaatcgttgcctggaggcacataggctagtccatcagatccaaaattccaaagcttggctgtgtaaagaacaacatctaggagtattgagaagcaatgtgggcagtgctgagattcaaaaggggcgtccctagtcccaaagacgagccccacccaagtgaatggacttcccgaaattatggtacctgtctgagcctcagtttctccatttgtggatgggaataatcacacaaagtattttgcagagcaaatgagaaaatgtttataagagtctggctgactgcgggaatgctgttatttttgagtttctcttcccttaacgatcaagaataattagagacttatagcagcctgggagaaagttatcaaagaaaggtgtactgtatctgcccaaattaacattaggatgtttcacgggagctacttatttcagaggaagagctacagatggtttggaagatgatgagctttggtgaatgctatgctctgagaatgatggaaaaacagatatgggagaaactagcaaagccgtgaagccattaaggaactgaccacctaaaagacagagtcaacaaggctgtgcaggtctcctagggagataagatggcatattagtcagggttctctagagggacagaactaataggatatatgcatatataaaagggagttaattaaggagaactgactcacaccatcacaagataaagtcccacggtgggccatctgcaagttgaggagcaaggaagccagtagtggctcagttcgagtcccaaaacctcaaaagtagggaaaccgacagtgcagccttcagtctgtggccgaaggcccaagagccactggtgtaagtctaagagttcaaaagccaaagaacttggagtctgatgtttgaggacaggaagcatccagcatgggagaaagatgaaggccggaagtctcagcaagtcggcttctcccaccttctcctgcctgccttactgccatgctggcagttgattacatccaatggtgcccacccacattgagggtgggtctacctctcccagtccactgactcaaatgttaatctcctttggcagcaccctcacagacacaccagaaacaatactttgcatccttcattccagtcaagctgacagttaatattaatcatttacagatggaaatagtgtggttcaaataagaacaagagcaccttgtgaaataacatatgtagaagccaaggcttgcaatgtacagtctagcagtggcctttcatggtagagagactcattcttgcataaaaatgaagatattcaattaacacatcctattggttgtattctataacagggtgagcacatttatttacttcagctaaattgaaaatcatggcctcacaatgtcacgtgtgtgtgtgtgtgtgtgtgtgcgcgcatgcgcacggtggtggtggttgtgatgaaatggaggaagaatatttgagataaagctaatctttgataaaattcctcctgttcagtggtgaaccaggattggagacagagaccaggggagctgccttcccaggcaaggagggcatttggtcactcaccttgtttagaactgctggctatgatacgaacacaaagcagactgacccttagtcagatctattattgttttaaattctctatagataatgtactgtcttatttctcacccctgggcagactgatcccaccaccaaccctgttctacctccaccccacactgcctctgggaatagcatatgaacaaatgtcattgttaattcctgatcagttgtggctgtgttatcaaagcaggagaatcattaggatgtatggattatggcagcttaaaaaaacaaaaactacatgagagacttagatttatgcttgcagaatgtccaaatgagttggaaaagtaagactaacaaatctagaataaaagtgaattgtctttgccaatttcactgccccatgggcagagtcaacagcaactactgtcaaaattgttcttgagatccatctgtccctagacataactataaaaaccttaactcatgggaagagtctacgtggcagctcctttgaaagctttccttgctgtttaagagaagtctagtctgccagaataaaaataaaaatttaaaaatctctactaagacaaattagaagataatgcaaggaatattgggtaaacatggaaagaagggctgcctgtaataagcagtaaaataatcttaaacattctgtgcagagtaaacgcatgtatatacaattaattccaaggccaaagggagtgagtgacatagagcgatcacatcattgtctgaggaaccattctctgccaagaaaaaaggcaacagtctcatattcttctctagattagttgactgtgaaaagaaaagagggcaacaagtcagcttcccttagagaggttgttggtgagtgggacatgtgttaatgagacacttcacaccttccctggtaggtacctggagcaggctgaaataagcaaaagtgaatgcaggtgatacaggtgtggggggtgaggggacagtcttccctacctgcaggggaaagcctgtcaagaaagcccttgcagcaagaaggtactcaaattaaataatgcttgatacatactacctacacactaaccttatggattagtatttttaaaagtctcacctttgcatcctgtttgtgagttagaaatgacttgactagacgtgatttcacatatcacgatttttaaaaatatttgcaattttctaagaatatgtatatgactaaacttatatggtataaaccatactggtaaacatgatgatgatgatgaagataatgatgattgatgatgacaatgatgataatgataatgtgctctctagaaaaaggaacaatattccagatattttaacatactgctactgaattagtccattctcacactgtgataactacctgagactggataatttatgaagaaaagaggtttaattgagtcacagatccacaggcttaacaggaagcatggccagggggccttaggaaacacaattatggtgggaggtaaaggggaagcaactgtgtcttcacatggtggcaggtgagagggagagcgagagagagcaagcgcaaagcaggaggtgctgcaaactttaaagcaaccaggtctcatgaaaactcactatcacaagaacggcaagaaggaagtctgtcttgatgattcagtcacctcccgccgggcccctcttctaacgcatagggattacaatttgatgaaatttgggtggggacacacagccaaactgtatcaaccacatttatttatcacagcagctattattatccctgttctatatagatgaagaaatgggggtttaacaaattgcccaagatgatagagctttgcccaatctatccatgtaccatcaaggccatagctttgcccttattttgcttgaagttgaaaatttcttttatattgttgtttgattttgttgtattacaaagccaaatctaaagaatttcactgtaataatatgcatagtaggtgtaattagaggtaggcttactttgtttatttatagatttagtttgcaatttaaaatccatgaagtgatagcatgtgtcatagcccatcatgaatttcgaatgaaaacactgtggctgtactgagcttctgagaaaaatccaagcgggtaagcaggagttctgagatggagatgcacaatcttaattacattagctgcctccttgggctattttgtgtatgtagtggggtgggcagtgggcttggttcttaatgtaatgagtgatttcaccaaggagggagacagggcttgacttgatgtgtatgggtagtaagtggattactagaagacttaagaacagggaggttagaggaaattgtcacattttcactgggttaggaattttaaaacaaaaatacgagcttcaatgagagaaggaacatacatggcctattttaatgatcatgagagcaagagactgtctgaagtaaggttcaattgcaagattcaaaggtaggacaatgagcatgttgaaagctaaggagaggaataagtgtaggaggaatacattattagggaaaaggaaacgcaaattgtatttcctttgcaatttgcaaaggaaaatttgcaaattttccttttgcaaaactaaagagaattgcaaaacgaaagaaaaggagagtgatgaagagaaccacatgggcaaaaaaataaagatgtagacaattctggatgatgttaacaaatgaataaaggcatgtgccagcagtttgcttagggcagctagtctattcagacagagagttacagggtccgtccgaggggtggaggcacaggcggctgtggtggaggggtgctggggctgaggtccagtgagctgcctgcctctgtgtcaagaaagaagaactgaaggtcacattctggaaacagaaatccactttcctaggggcagtgtgaaatgttaaaaggttttatgttatgccagagaggatagttagacaattagagttatctgaaggttgacaaggcagcaggcttagatgaattacactccagcagtgtggagaggaagcgccagtgaaatgtgaaatttggagaggctgagccactcccagcactgggggaaaggaggtggctctttgaattctgcggtgcgggaatggcagagcacacctggaagccaggagggagcaggtgttacccttgaaccaggcagacgtgggggaggcccaggcgtctcatctctcccctcctcctgccctgtgggaagagcatagtccccctctgcctttttctttccttttgtcttcagtccgccctccctgactagtacatggtcggtcaatcctgtcatagaacagaaactagatgtttccagaatttttatgccacagcgcttgaatgttctattgtttcacaatgctttgacacttagaagacaatactacatagtagacacttaaaataataggaaaaattgtctgtcaaataaatgacttagaagacctggttactatgtccaataaatacttggtgttttattttactcacccctcttaacttctccttgtttcaacacctataaaataagaagagtaatatctgcgctctttaccagttttcctgaagaccacatgagataaatatgtgaaaacacactatgaaaagcacaaaatgctttataacctatagcattatttttgtaagaatgaagcaaaactgtaattgtgtctgaaatctaagaatggatagagggaagatatattccactgtagactcgaacatgatttgattaaagtctgactataagaggagaaaccacttcctgatgaattatgagacccaatttaaggaataaattattggattggcttttaaaaaagtccagtagtggccgtaatttatcttgattagtggaaaggtttcataaactacagtgtgcaaaatattgatccatttagtaagtacaccatgcaggggcccctgcagaaggcaggcacctccagctctgcagagggcagcacagtggcccactgccttttatcacagctgtggaaccaaatggaaactggacgccgtcacggaaaacgatcagtctgcatgacgggcgcatggaaaggaagcctgacatttgaaaacacgtttcttccaaatatctttaaagatttctgaaccagagctcacccacctatctgtagcctccaaattatgaacagaatcatgacagaatttgggtttgtttcccagtggctctgccttcttttgttcttaaatattttttccaaactctcagatcataaccaaataacaaaggaagcagctgtgatgctcctacactgtggtaagtcccctttgagaatcgtcattgtggaaaggagagaaacttagattcttgattctcagtaggtcgttcttgatgaacacttgctaaccccaaggcattcatttactggagcaaggttttgtgcatttcagatgtcagcctgagattctggtaagatgttaggaagtgctccagctgggaattgccaccatagttccttctcagcctcactttagagaggtcaagtgcatctagaaaatgccaggctttagagtgacagcatgaaatacccccttgggttcttttttctttttctttttcttcttcttctttttttttttttttggagacagtgtgtcactctgttgcctgggttggaaagcagtggtgtgatcatagctcactgcagcctcaatctcctggactcaaacgatcctcccacctcagcctcctgagtagcatgtgccactatgcccagttaatttttaaaaacatttttttgtagagatgagttcttgctatgttgcccaggctggtctcgtgctcctgcccaaaagggatcttcctgcttgggttctttagcagaattccagaggctattcctacctgttgtaatgaaacttctcgatttgctctcctctccaaccacaccctccccatcagcatcttctcatctgccctctggggatgtggattcccttcggcctatgaaggcaggtctcccatttaggatattcaaaagcggtctggtgcgggtggctcatacctgtaatcccagcactttgggaggctgaggcaggtggatcacctgaggtcaggagttcaagaccagcctggctaacatggcaaaactccatctctactaaaaaatacaaaaaaattagtggttgtggtggcatgtacctgtaatcccagctacttggtaggctgaggcagaagaattttctgaacctgggaggcagagattgcagtgagccaagatggcgccactgcactccagcctgggcaacaagagtgaaaactccatttcaaaaataaacaaataaataaataataaacagaatatgcaaattcaactccaaacccaaatgaggaaggccatcaaataagatagaaggtaatggttcccactatttgagtaagacagccacatggggacaaatggcttgtgcaatttagtggagtaaatggcacggccacatgaccttgtttggcttctgttggttagcagagatccttggcatcagccagatccatttgttttcttgaatcttagcttttcctctcctttgtccccaaatatcaaagggcaaaccacttgacatcatttctagctgtcatttcccaatgcagtagttttaaagcctgaaaagccaaaggcaccactagaaattacatatattgtggggcaacacgtggaacttaaagaaagtgagcatgaggaggagaggagagatgaggcgaggcgaggggaggggaggcgaggggaggggaggggaggagaggatgaattgctgccaggtgctgccccacttttcatacctatccaagtgactcttccagattctaagtacattcagattgtgttttagtgaaatgcagtaaaacaaacagatgttaaattgctttcatacatatcttgttttatccccataacaattcagtttctggctttatcatacctgtttgagagatgaaaaaacaagactcagtgagatttatgctccccaccaaaaatcacagcaaattcaccacagaacctgaacagtaactgagatcccgtggaaggagagcagaccagggaggctgacgttgttataggagtgtgtgcattttacctattagttcaaggggttttgttggtgttttatcatgctccacaaccaatagcaaaagcaacaaataaatggtataggacagtgcaaaggaataggatcatacccaagtgcgttttaacaaaataagtaaacaatcagtaaaatgtatctgggagtgctggctccctcagggcccctggaacaggggtgcatagttaagaaatatacagagttctgctctaagaaaacgtgtattccttaaaaaccaccacattatacaaaatcacaccaataaaaacacaacagtaatgagagaaatggggttatggacacaacatttaaatatgttgtcagtgaaaaataaaaggaacatagtaaaaatcggtagcatagtttcacacaagttatatggttaagaaatacattgaaactacaagatatatggcacttcaccttgaaaaaagccccagagttcactcggaggagtaagagctgaaaaggctatagttgtgagtgtttgggaagaggtagaagcaaaggtgttgaaatcggacggaagtaacaccagacatggatgcgtgtggcctgtcacacgcggagaacccaggcagtggcagcttgatggtgtgcagccatgtgttttatgaatttctacagactcaattcctgggctgcaagcagtttttctgcattcacttagtgcttctcccagaccaaatcacacatatgcgaacaggaaattaacctgatgctcaaattgttctctaatctatcaattacattgaaacaaagtcacattttcaaagcaagcattttaacagaagtgactgcacctaggtcctccctctacggagcttacagtctccttcagaataaaatatggacaaataggaaatactggattcgtaagtgccaaactaatatgcaggtgttttggaaagggaggggccgctggggcagtcaaagaagtttgttgcaagaggcaattccggaagaaatgacctaagcaaagtcagagaagtggaggtaattgtgatgggagaaaagagaggaagaggtagaggacagagaggacagctgctcaggggtgaatgagaaacaggtttgagcagaagctgggctggctgtgataaatactgaggaatgtcactggaatgtcactgcaaaggaggtgttttttaatgtttgggtgtaaatcaagtctgtagcacagactgagggaatgaatattttacagaattgctgtcatcgttctgtatcttacagcccattctgttcatttctcattcaataatatttattgagtttctgttgtatgccaaacgcgttcacaactgtggattcagctgtgaacacaacgggtgaagcatctaccgtaaggagtggacatcctagcagagcaggcacgtggctgctggttaaggagacgggcacccagtgagctcaaaaagcagccagggctgcggcatgaggcagaatcaggagtcagggaaggatgagccgtggaggaagatggctgtctcagagagggtggccagagaggtcctctctagagaattgacatgtgaatcccgaggtgcccaaaaggagtgggagcaggtctcaaaaagttggtcccaggcaggggaagcaatggatggaaaaatctgacatgtggagaggcagccacaagtctgtggggtgggagcggtaggagaggatgtgggctggagtccatgggtaggagttggggctttatcctcagttccgtggaaagctgccaggtcatgttgagcaggagtgtgttgtgatcggattcactttttaaaaaattattttatttccataggttattggggaacaggtagtggttggttacacaagtaagttctttagtggttattcgtgggattttggtgcacctatcgcccaagcagtatacactgcactcaatttatagtcttttattcctcacccctttccactctttcctcctgagtccccaaagtccgttgtgccattgtgtcattcttatgcctttgcatcctcatagcttagctcccatttatgagtgagaacatatgatggttagttttccattcctgagttacttcatctagaataatagtctccaatctcacctaggttgctacaaatgccattaattcattccttttttatggctgagtagtattccttcgtatatatatataatacatatatatgtataatatatattatatatattatgtatatataaaatacatatatatgtataatatatatattatatatattcttgcaattgtgaattgtgctgctataaacatgtgtgtgcaggtatctttttcatataattacttattttcttcttggtaaatacctagtagtgggattgctagatcaaatggtagttcttttggtgtattttgttgtttgtttgtttgtttagatggagtctcactctgttgcccaggctggagtgcaatggtgtgatctcagctcaccgtaatctccgcctcctgggttcaagtgattctcctgcctcagcctcccaagtagttggaactgcaggcacatgccaccacgcctgggtaatttttgtatttttagtagagacagggtttcaccgtattggccaggctggtcttgaactcctgaccttgtgttccgcctgcctcagcctcccaaagtgctgggattacaggcatgagctgccacgcccagccaattcttttagttttttaaggaatctccacactgttttccatagtggttgcactagtttacattttcaccagcagtgtagaagtattcccagttcactgcatgcacgccaacatttatttgctgggataattggcaagctacatgtaggagaacgaaactggatcctcatctctcaccttatacagaaatcaattcaagatggatcaaggacttaagtctaagacctgaaactataaaaattctagaagataacatcataaaaacccttctagacattggcttaggcaagaatttcatgactaagaacccaaaagtaagtgcaataaaaacaaagattaatagctgggacttaattaaactaaagagcttttgcggggcaaaaggtaaggtcagcagaataaacagaaaacccacagagtgggggaaaatcttcacaatctatacatctgacagaggactaatatccagactctacaatgaactcaaacaaattagcaagaaaaaaacaaacaatcccatcgaaaagtgagctaaggacatgaatagacaattcccaaaagaagatatacaaatggccaacaaacatatgaaaaaatgctcaacatcattaatgatcagggaaatgcaaatcaaaactacaatgagataccatcttactcctgcaagaatgattcacattttttaaaagataattttgcttatacttggagaagctctaggggaaaaaactggaaacacaaagaggaggtatgggagagttgatggtggcttggacctgggtggtggatgtaagcagggaaggaaggaaggaagggagggagagagggagagagggagagagggaggaaggagaaagaagagagctggattcagtgttttgaagttaaagcccacagggtgcactaatagactgctcgtgaaatatgaaggaaagtgaaaattgaggataacttcagctctgcccccttccccagaactgagtagatggagatctaatttactgcgatgtggatgactgggagggcggagtgttgtgtggactccccaccccagattcatatgttgaagagctaattggttgtgaggacctcagaatgtgactgtctctgcaaatcgggcctttaaagaggtaattaggttaaaatgaggccatagaggtggaacttactctaatatgactggtgtccttatgagaagagaacatttggacccacagtgagacaccaggaatgcactgccacagagaaaagatcatgtgaggacacagtgagaaggtgccgtctgcaagccagggagagaggcctcagaggaatccagcccagccggctccttgatctcgggctttcggcctccagaactgtgagaaaataaactcctgttacttaagccactaagtttgtggaaagagagaactcaagggggctttattttaaatatgttagaaagtgtcaaatgaagttcaaaaaaaaaaaaaaaaagactagagactctaggttaagcttacataagagacccaaggacagcaaatcattttgttggggataaaagtgatatttgtaggcaataatgcagcttctctgattttgtactaaatacgttttagtaatttttttgtggcccagctgaggatagcttctcgagatacccttatggtttaactgtatttttcacgcactgttactggctaaggtcagtggatcaaagagacacagtagtctatgcacgtttccgatttattaggttacgacagtggggaaactttctccttagtctagtccatgaatctgctcaccaatgaaaaggaaatatagctaggaattatagcgttactgactccgtaatacttcaataaaatctgttcccagtttgagaaggagtcgggcaaacacaggaacttgcttaaggaaaataaccatgatatagataaccaacagaaagtctagagtaagaaacctaccccactccctttctagcagtgattgcctattacaggagaaaacagattggaagaacaaaggggaaagactcaacagaaactgtaatgtgacatagcttagtctcctgaaaggagcaaagaaaatcagctcaggagtaaatcaggatctctcttctcttgccaggacaaattcttcacttttaagatcaagattagggagctgattagaacaggttagcttctgtttatatatgagcagtttttaattccatagccattttagaagaaaaatctgagtaatcatcgcctcaatgacagaagctagatcaacctcccacaagctgcagctttagaatattggatggaaggaaattgatcctgagatgtggaatcccacaatattttcactaacaggtttccatgagaagtgggtgcttcattcattcttgtctacacacctatttctgcacttcctcctacaatatctcttttgagccagcctcagaccaaacacgactgcattccaaacagtcctctgttatgttctttttattattattattattattatttttgagacaaagtctcactctgtcacccaggctggagtgcaatggcacgatctcggctccctgcaagctctgcaacctaccaggttcaagtgattctcctgcctcagcctcctgagtagctgggattacaggtgcccactaccacacacggctaatttttgtatttttagtagatatgaggtttcgccatgtttgccaggctggtcttgaactcccgacctcaggtaatccacctgcctcagtctcccaaagtgctgaaattataggcgtgagccactgcacccaaccttgttatgttcttttcttggaggtctgtgggaactggtatgaaggtggtacactataaagaaaataacttacatggccaactagagttctgaaaaaccctcttctttaacacaattaaagctcattaaggttatgttgtgctgcaaagtggccttttcaaagagtgtgagaggtgcattttattcacatatatttgcactgagttcaagtatccctaattctcattatgtgtaatgcatttactgtgaaaagacatagaatattgaaaccacaacatgacatgcatacaattcataacaaagctttcaagctatgaaatatttcatggtaggacagagaagcacactccgagttctttgtagtagagttatttggtgtcacataacgattaagaacaatggctccagtcacaaaggcttgagtttaatccttgctcaacttttaattggctgttactttggacaattactctctcttaagcctatttccacttgaaaaaaatgggtaataacaatgtctgtcttgtaggattactgtaaagatgaaaattgtattatcaaaagctgagtatagtgcttggtatagagtgaagagggcccgcattggtatctgtgatgatgatggtggtgatggtgatgatgatgttaatgatgttaatgatgatagtgataatgatggtgatcctgatgatggtgttgatgatgatggtgataatggtgatgataatgatagtgatagtgacaatggtgttaatgatgttaatgatgatagtgataatgatgatgatcctgatgatggtgttgatgctggtgataatggtgttgataatgatagtgatagtgatgatggtgttaatgatgatagtgataatgatggtgatcctgatgatggtgataatggtgatgataatgatagtgatagtgatgatggtgttaatgatgttaatgatgatagtgataatgatggtgatcctgatgatggtgttgatgatgatggtgataatggtgatgataatgatagtgatagtgatgatggtgttaatggtgatggtgataatgatggtgatcatgatggtgttaatggtgatgatgatggtgatgatgatggtgatgataatgatagtgatagtgatgatggtgttaatggtgatggtgataatgatggtgatggtgataatgatggtgatgataatgatagtgatagtgatgatggtgttaatggtgatgatgataatgatggtgacagtgatgatgttgatggtgttaatggcgatgatgatgatggtcataatgatgatgatggtgatgcttctgatgctgataatgttaaactgaaccaagtctctctgaaatgaaatgtggtgcagccttcttagatcattgggcaaaaagaaggcctctcaggacatgtttctgctgtagcttgtgccactcaagtccttgggatgctttgtaataagaaatgaaagttagctgaatgtattttacagaaatgcaccgtttaatactcccttacataatgcaggatcaggagatatagaagtagacaatcatgttgtaacttttaataaattgttcaatcatagtattcaatgctgctgcaccattgattgtattagcaagcatcaaaaaaatccttaaatgataatgtagccgacttacacaaaataaacttaagattactgttttggtcaaagaattttcttgggtcagtagagggagatgaggaaaagaaaaatattttattatattgtagtatattaaataggttttattgtatttctttttaaaaaaatatacaagtgagtattctctcaaaccttagactttttcaccctggcctttcattgttacttgactggctgttactttggtcctatttttaactagcaaaagatcagacaaaataaagggaagaaaagacaattatctaaaaatgcaacatgtacaactgcacagtctagaaataacttgggtgtccacatgtgaggtaagcatctggaactagcaaaccatggtgagacattgtagactcatccccctcccattatggacttgacctcccatcccatgctcctggagatctggtctatgatgagatttctctcatatctctatgagagatactgttgtcgtttccttctgagtatctataggtgattaactaaaccgatcagactgggaactcctccagtgctacactgtgtacactggttgaataaatgaatgaacatataaaagaacaaatgaaaccatatcaggggtgtcctcaatttggggagatgcttgaaatcaatctgtcttatgaaggaactaggaagggttacagtcttattcaccaagatctggcgcaggctttgaaagaagggacacctgacctcaggtgatccgccagccttggcctcccaaagtgaccccatctctactaaaaatacaaaaattagctgggtgtggtggtgcacacctgtaatcccagctactcgggaagctgaggcatgagaatcacttgaacctgggaggcagaggttgcagtgagtggagattaagccattgcactccagcctgggtgacagagcgagattctgtcccaaataaaggacaaagaagaatatttgttcattctgtacacttggccagagatgtttttgactgaaattcattggttaactaacagtgcttactgggttttatcacataagttcatataaatcaatcaatatgattacatatctgttcaatgaaatgattccaccagaggttctcaaagtgtatctgaggaccctgggggtacccagcacctttcttaggacatctagaaagtcaaaactattttcataatgatatcaagatgttatttgccttttgtactttcattctctcatgagtatgaaaaattaatcaatttggtttcagagtgcacattacaactaaccttgtcaggttttgatatagtatcaaataaaaatattcgcagttatctgataaagcaattaaaacatcctccttttccaactacatatttttgtgagactagatttcttttatatacttaaaccaagagtaatatattgcaacaaattgaaagcaaaagcagatgttggaatctggctgttttctattgttttccttcttctattaaagtcaaggttactaagatttgtagaaatctaaaacaatgccactctgctcaccaaatttttttgaaaataattttgcataaaatgtgctgattatagtaagatataatagattttcattttgaatacttaaatattcaacattttttcattttattattgtaaatatacaataattcacaataatatattacaatatataatatatatttacaataaaattatatatttactgtaacaaattatatatatatttatcccttatatatattttatatatatcccttatacacatatacatatacatgcacatacatatataatgtgtgtatatatttatctcttataaacacatacacatgtgtacacacacacatatatgcacacatacttatatatgcgtgtacatatttatcccttataaacacatatacacacatgtacacacacatatgtgcacatacatatatatgtgcatgtatatatcccttacatatacacacatatacatgcacacatatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatttatgtgtgtgtatatatttatcccttataaacacatatacacacgtatatgcgcacatacatatttatgtgcatgtatatatttatcccttacgaacaaaagctctttggggtcctcaatagcttctaaaggtgcaaagggtttctgagaccaacatgtctgaaagccactgaattaccttaacagctcctaggtctgaaagtttatggttctaaaaaatgcccagcacttgctgtttctatgaggaataaaagtgattgtctcaccatcaacactgtctacaacactgttagggagacaaagcttatctacatcaacatgatggattagctacttttcttagttctttctagctcccacaacaaaataccgtaaactgggtggcttataaacaagagaaatgtattgctcacggttctggaacttggaagtccaagatcaaagtggaaacagattcagcatctggtgagggcccgttcctcattgacagtcatcttgctgtattctcatatggtggatgggactagaggtctccctctgggatttcctttataagggcattaatcctattcaggaggtaacattcatgacctaaccccttccggaggccttgcctcctaacaccatcacattgaaggttaggattctgacatagggattttggatggatgcatgcattcagaccacagtgacagcctacaatcaagttctaaattgtgtagttcaaactaggagaactgtgaggagatggttttggggaaagtgacttctgcatttgcctcaatgattttccctgcgatgacacgtggcctgctctgaacagtgtttgttccacaaaatgctgctgtcctttattcagaaactttctattgaaaccaatttttatctcaataacctgatttttaatctcacaaaactggacctggtgactttgaattactatattagaaccttgtaaattgccttgtttactgattgttttaacacaagatcctgtcatctcactagactatgtaaatttgcagataaaaatgcccatcttagattggtcagcctgggggtgaaaatggactcaaccacttctatctattgattaaaggactctgagtaagtctcctaagtatatgtttttttttcaatctgtaatatcaggatgttagctgtcatttttaagcccctgtgatatcccatgtgatccaaaagacactttgtataattcatcaattctcaaaacaacatgctgagataacgtaattttcattctctataaatggggaaaccgaagatcaaagaattgaatcatggctaaaaccacacaactggtaagtggaaaggagttccacttaaattgaacttataactttgatctaagctgtctgattctaaagctagtgattattttcctattattttgatggtcagctcttaagagttcttgcaatagttgaataaagtgaagcctgtgatagcctagtgcgatgtcaggtacgtagtcagtggtcactcagccttggttccccttgtcctgcccttctcctgggccacagtgctttgtagagctgtattgtaccatcccagtaggtttagccacacagagcccatgagaacaagctttgcacttagatatgctgtccatgtatttgacaattgatttgctgtcctgactttgctattacctatcctcctgatcatggacaagttcctccgcttctctgggctttggctttcttttctgtaaaaggatgaatttggacaagattaccatcagatctatagattttctaccttatagatctgtactattgctgagatttttgtgacaagcttaggagttccccaaaataatgaaactgtgctatttgaacattttctctgaatctcagaggtacaaatttggaaatctacattgtcattaaggaaatgtgatgtataagaaaaacagtaaagtatagctgccgtataccgtacttcttaggtataaaattcatgctataaaatgactttcttcatctggtgtcaaaccctaaataatgggaaataatgcaaaggaaatatgtttcctgatagtcaatagaaggaatgacggacccagcagccatgtgagggtatatttaaactaagaccttcatttcatgcttctcatgattctaattctcattttcccatcgagttaaagggggaggattgagtttaacatgtgggaagagtaagatgccttggttcttccattgttagttttccatattcaccatgttgtataatcattaagcgtatttaatcgtggttattgagttaaaaatgaagtgttaccacccggttttgcagcatgtgccgtaattgttaatctggttatgccaggttgctatgcataaacaatgtctcacatcaatttagaaaatatgatcattactgtttatgaactgataatatagaaaaaaccatttagaatggatagaaggaaaatatcatttttctaaagaaaagcaaaagaaaacatgtcgttggcagagtaacaacatgaatcatagaatctagaagctcgtaagggtctgagaaaccatgggctccagctcaccaagtaccagaatgtgaagtgatgtgtccaggtgccatgtcccccagaggatgctcaggtctaaggctgaaatggccaatctgttcagaagcacatgggtctcctttcctaataaaggaagtagctaagatccacccttaaggcggcaaagtgtgtactaaggcatcaaaaggacaagtcaggtagtgagtaggtcacttattaccagactcaataccagtagctcctgcagaacaggggatgacttttcctctgaaaacaagagtacaagtgcctggtctctgggtgtgcctatggggaaattctgccctggttctggggctcagtctgattccaaagcacacagtcctaagaatggggctttccacgcctcagcccctgtgtcttcccccttcacctcctacaacactgccccagtccgtgtgggtcaactctcctttttctcaaaagccttcacttctaaaagcaaggttgtttattaagttaagtgacaaagagatactgcaacaataataagctgtgatcaaagactgggttgatgttccacatcacaagcactttcattggaagtttctaggattccaggatgtctgtttctgtgaatcccactcagaagactgtgtcttcattaatcagagagaagacaatgcaaaattttaagctctggtaatagtctatgtaaactgactattgtccatttattttgtctctactgagtttaaagattcagtgataccccatttatgtgtcgatccaatcagacaggtaccagaggtgtctctctctggggtagcaaactcagaggggacaaaaatgacagctctactattggttgtggttgcgaacacatatattgttgcaaagaggaagagcctattgaaatcagacgtgggcaggtgttgagttctactgtgatttgctattttccatcatacagagcaaggacaaccagaactgcaaagacagaggccagcagtggtaatgaggactgaagagaagtcccagcatggacaggaggcccttatcatttttaaacagcacaattccctccatcttacctttggcactggagataaatgaaataggctgttctgtttgaaaagagtgtacctgctcagtgggaccagcaagcaccatgtggccatactgtgacagtcatcaaaagaaagagtgcaccttcctttgcagtgataagggggtcacagagaaagcctgggggtcaaagctagatacaaggcatcaggctgccactctcatccagggacacaaacattcttgtctccaatattggatctgaaagtaaaatcaacatattctgaaggaaaaggatccagtgaaggaggacagtattattcagggaggccttgctatacctttatctccggggtttcctgccttacaggaagatgttgccttatagaaagatttatgaatgagatgctttgatgaaagtctgtaaccaaaactcttagctatgtggatggataactatagccagcttcctggtttcaaggaaaaagttctcaaaactctctctacattttgcatcctgaaataatcaatgtatctacctccctggatagacaattagcttcttgagaacaagtaccctgaattgttcactttcaattccctggctgccagcacagtgccttgaactgaactgagcttctacctaagcatctgtatcttctgctaaaagagacctgcctgctccatccatttttaacaggactctttcctaatatttgcttttaattaaatggaatattcatcaaagtgaaaaacatgcttcacttagtacattacctcagactacagagaacacacctctgttacttcttatggtccttttgggacagctgtggatttagtttcatagactttattagcataattgaaaaagacaatccgaggggaagcattttgtgcaccgcctggatggaaattatatgaaggtggcattaccagtactgtacttgctactaaaatttcacctaaagactcattgcaaagcacttgggcaaattttccttttctcacttggaattcaattttgaaaattgggggatgtcaagaatttcactgaatgaggttcatttttaaaatcccattatgagagggcagtgtagggggactccattagccccaggagtgttgaggggaaacgtaaatgagtgaggccattaaagtccttagaccacgggggcctcaatagagcctgagatggctgctgaggaggtggagacatggtcatgataaggactgactcccagcccagaggatgatgagctggtgcgtgttctcatgctgtgtcaaacctccttgcatatcaatcttctgttcaccctcacagccaatcctgaaatccatcctgtctccacatctgtggagtttcctgttgcatggagctcctcacaaaagtctactttccaagacagctttccccaacccagaatgacagtgggattcacacattatcaagaaaagtcacccatttcattttgttcccactggagtctcttttatcacttccctcacaaatgattctggggatatttaaactaattttctagtgtagaagaatttaatggatgtgtggacaccatgaatacagctgctgctcagtgcctgtacttgcttttgtccccaggaattgatttgagtgcaatcaatttgcaattcccaataatgtagagagctgcctctttgtctcagcatctgtcctgctaactgtgaggcccgacactatggtgaaggaggcagaataggaaaggaagagcttctggcatgagagacagaaaaagcttcagatggaggatcaggaccacaggcacacatcccctaaagatcatggaaataatgacaaaatacaacctgcgttacagccagctcccctagcaaggtgtttattctgtgcaacaagacacgcttactctcaccattaggatcatcattagctttaaaattgtcaagtgacaattacccatatattgcggtgatacactttttatactgaagcaaaatacagtcttatggatgggttattttctgtgtaacaatgcacatcattctgcaagatgaccaaacaggagagaaaacaattcacgttctgtagattacttgattgtgccccattttgttaatgggcagtatattttaaactacaatttcaaagtcaaatgtctgcattggttgtttctttaagtgtaaagagatcagaaaaaaagggtttattccttagaatgagtttccctgagatgtagcgaggacattatagtcagactggcacaagcaaagaaacagttacagcagcaccaacaattaggagaaaaattggactccaagtgaaacaatgctaggcgtctcactataaatgctatcaacactttgtgtgagacaggtgcagagtgtgaaagcaatcattcgtacagataatcactgtatcaaatgcgtgtccctgcctggactgcacctgccacaccttttcataaagccaggaagccagacaacagtgtcttgttgagggttggctgtaccatatgggaactgtgagccctgcaccagcatcaggtggtgcttctgttatttgctctctcactgatttagaggagtcctgagaaattgaggtcctcaacagaaaacacatgggtcagtgttaattcatctccagtgacctttgctgctgtggaattctgtagtcctgtctctgttccttcttttatccaaggcttctcattgcaaaatggaaaccgtattgtcaggttctaagttctgagcagcattttgattgggattctatagttcctcagtcatatcactattcttatcatggtgataccaatacaattattacaaatgcaaatacaacccccagttttcctgcaatagaatatgtgagccatttcacactggagttgatctacataaagtcagctgattctaagagctcagatccatacacccgcccctgcctgtcaacatggccactgaccacgctaacacgctgacgaggtgagtccttcacctcttggcaaccagaagtgttagaccttgaattttagcatttgctgaatggagatgcttccatgcactttagaagatttgattcttctgcaagaagaattctcctgttaaatatgcaaaatacgttttttttcttgttctttggcactagttaccaaaatctgcaagtctgtctatttttaatgtaccttcttttaaaagcactgcagtgcctatgtgtatattaggctctaaacctggctctgggaggtcatgagtataattttagacctagcaagttctgaagtcactgtttctcttgtatttcacaatgaaatgtcaggaataattttttgaaaatgaagtggaaccttcttttaaatacgagcccttcatctccatcactcctcccaggctctgtcataatcacaggccgggagctacatttctggctgatgggatccttgtgcagttggcacaggctctgcccccatgcctctggaccctcagctgtccttgcacacctgctgcaggtgcactgtcatgctcagggcagcacctgtgtcctttcattggcacttccggcacgctgccagagctcttactgcccgcctggcctggtggctggaaatgcctggggattttgcccctttgggcagcctcagccaaggactgccagatgtggggaaatatattccagcctcctttccccagcagcagctctgaaggatggcctacctgctcctagagtcctctgcagggctgaggcacagttctacctgtgtgacctccttccctctgtgtcccctccccatgggtttcccttgaaacacatcttataaaatcacttacctagaatacacatttaagcctccttctcataacccaacaccttggcccaaagagcggaacaaagagccggaaccctggggagttgtagcctatggacaccaggtctcggggcctctcctttaaggatatctcttttttccaaacagagtttaaagatgtccttgttccaaattgagaagacaaaaagcaaactatgttgcaggttttccaaatgatttcagaccagatttacaatggcttgctctttaaaaattgaagaaattcacccctggtatgccaggagcctgggagtctgcaccaggattgtcccctgcagatgtgaggacagtttaatcagctccctcctcagtgctccatactctgtgagacgttgtggggaaggcagcatttaaatctacaaataaaagtactggatccctcaagaggaggagagagtggtacaaccttaatggccttaaaggccaagaacttaatggccaagaagccagacatggagatatccatggccattctcaccccactctttccttcccactgcaccagcccctccggctccaaatcaaatagctctgaattcagaatgcaatttgaaaacttgggaatcaaggctcttctctgtggatcttgtatttgagatagtaagaccttgccagtgccttgaagttatctatttaacctagcatagccgtcactttggaagagtgaggccagcactccaggctacgctgtgcatgagaatgaggacaattttgctaaaacaatacaatgcttctttactgagggtgggtctattttgttttaagcttatggatattatcttacaaatacctgttaaaaccccatgcgtagttaataatcccattttagaaaaaaagccactttgacattgaattgctaactgatttttcccaaggtcaccccagtaaaagtgtcagattctgaaatcagattctgtgctacttgatgttaatgccccgtaggcctctcaatcataaaatgccttagagtcacagtgggtgtgacatacgtgaagttgaggaaagaacatttcccttttgacagccagaatagaatcgtttagcaaatggcattgataaggtcaataattcaaatgggaaattagagtattattctgacctcacaatagaattgattaggaaatggcaatgataaggtcaagaatgcaaatgggaaattaagagtgttattctgacctctagggtagagaatgggacctctgctcagctttaagtgaggagcaagacagaatagtgatggtgagccctggagatgcagtcagttcttgctgttcacagtagtcatgctctataaggttgccacaaaggcagaattaactaatactgagctgttgctcctagtggaaatgtaaggttaggttccttcaagcctcgggtcacaacattttcatccacagatccacacataagtttcttaagtgagcatttctgtttaaaaacattgtattacatatatagtcttcattcattaacactgatttcatggccaacggtactataacacatgcctgcatgaagcttttccaacacacatattcttctccataaggcacatcacggtattcttgtgcttgggaaccctacacagcacttcagcacgcacttgggggccattttaaacagcaaaatcaccaacaaaaaatacaaaaatgtggaactaaatagaccatgaagaggacacttgtttatagtatgagctaaagcaagaaggcagagtgccgtcatgttcagacccagctaggaacatgtgtgtcaggcaactcacttttttttccactgtgtacatgactgcaaaagacctggaaagcaccatgagtattgatttgcaagttacacataaattttaggagtaggtcgatctgcaaatattgcatccatgaataataaggatcacctctgttagcattagcacattgcccattgacaaatctactggattcatctgagctagtaaaaacaacaacaacaaaaaaaacaattgtcaatcagaccaaaggtaatctccattcgtacacaaatagaaggaacaattagcttgggaagatctgcctgtttatttaattaaaaataaattttaaaagatggaaggctgggcatggaggctcacgcctgtaatcccagcactttgggaggctgaggtgggcagatcacttcaggtcaggagttcgagaccagcctggccaacatggtgaaaccccatctctactaaaaatacaaaagattagccaggcatggtggctcatgcctgcaatcccagctacttgggaggctgaggcaggagaattgcttgagcctgggaggcagaggttgcagtgagccaggatcacagcactgtgctctaacttgggccatagggtgagattctgtctccaaaaataaaaaactaaaagaaggagaagaggaaagtagtcttctctctcttgctccagcagttctgaatcacctttgtgtagtttcttgatgttcttgcttttcctgtgcaaatgggtagtgaccttaacagtgcatactgtgctgaaactctccccagtgagagttcttccacatattctgagccatgctgaataatcaggcaggtgcacggctttgcccacactcaagtgaggaaggaccatgggactcttcccgtcatgcgggcgacagatgtggttcagccactgcaaaataaaaagccaggccctctgtataacgaaattcagtgaccactttgtttcattaagaggcagtctgttctgtggacctgggagggagagacagggagcgtttttcaccaacaacttacaactccacagtaagttgagaggagtcccgactccatgctgtatgaagtccagcactgacacaccatggccagcgaccaacttgctaagtcaaaaaaatctaactcagaaccctttgactgaggaacagttttcacactccagaaaattctaaatgactttcatttgctgttggttcacatgccctcgtggaagactttgcttgctgctttgttttcataagcagcttgaaggaaactcaggcaggaactatggaactccagctgctgctgtaactgcatcttgacgatgcaaaatgacgatggaaatatagaagcatgtacatcatatctatcatgaattgagcatgtgggtctgttccctcgaatgaaaaatacatgcaaataaaaatatttggctataggtggtgcaacttttaacagttgttctagaacttacacatccaaatatgtgttttcactttgcacagggtggcctatggagttttatgcttgctctagtaatgttgtagtggaaaacattttggaagtattttaatgtattaaccacattgtttaatatctttaacctcattaaatcacagtcctttaaggaatgatatgtgtgcactcttgtatgtgtatgagtgtatgtatgtgtgtgtgcagttgcatgtgtgggagtggggatgcacgtgtgtgtttggtgtgtgtatatgagcatgtgtgagtatgtgtgtatatgtgtgtgcaattgcatgtgtatgtatgtgtatgtatgtgtgtttgttgtgtggtatgtatatgggcatgtgtgtgtatatatgtgtgtgtgcagttgatgtgtttgggggatacctgtgcttgttgtgtggtatgtgtatgtatgggcatgtgtgtgtatatatgtgtgtgtgcagctgatgtgtgtgtggggatgcatgtgtgtgcattgtgtatatgtgtctgggcatgtgtgtgtatctatgtgtgtgtgcagtttggggatgcatgtgtggtgtgcatatgtatatggacatgtgtgagtatgtgagtatatggtgtatgcataattgtgtgcatatatgtgtgtgtggcatgcatgtgaggcacgtgggggtttgtgtgtgtatgaagaacaaatcatttggaaacaagtatggtgaatccatctaggtagtttggtgtagggttaaaaaatgattataaattttgtgattgattttcttattggtccaaagactgattctggccagtatattctaggactacccttggtggtggtatcatggggataaaaatgtggctttctgagacaacgccttggaagcgtgtcacttgctggaacataggcatctcagtacagcaatatgtagagtagcacgccatgcctgtgggcctttcaaaagtcctcatgtgaacgtgagcctttcttcctgtggtactgatgatcattacgttcacgttgcaaagtctcattagtttgatttttgaacccagttgttggaaaagggtgttgatgtgtcccccagaaatggggaaggtgctgaatggaaacctaacttaatcgtactgtggattgaatgcgttgcctttttaaagaatgtcttggcagttcccgtgattttgtctaactctctggctattttttcctctctggatttagctctaaatcaaaaacccacacacaattactgcacaggggatgacccttctcagaaaaattccaaaacctctggagtagattgggtttttttacccattgagataaagaaggatattacaccatagttttgaattacaatgctgatatcctattcagggcttattaggatataacttgaagtaaatgttgagagtaatcagcaggacattttgaaagaaaagttacagttaacctagatgacagttaaacaattgtttatccccgataactgcattcagatgggccaatagcagaagtcactctgaaattcatgaaagtgtaactaacaggactgtcactactgcaagcagcatatttaatgtttttactgtttttttataaaaaaaggtttctattacagtgttcttgagtattggactaaaatgcaaacgtcacttgtaaatctattcctttgggcttcatgaagatttgaggtaggtgctcaggaagtgaatctccccaagaaactcctctcttagaatacactctgaccccaagcctgttggtagcaagactgcaggagcacatggctttgcaggcagcagaccttggctcatacccaaactccccactcactgaacctgcagcctcccccttccatcttcgacttctttatttggggaacagccacaataatgctggtggctgtagggactggggacaacatatccagcgcagagcttggttttattagagctatttaataaatgatggtcacaaatatgactattaataattagctattaattcaatttacacttggatttaattaataatagtaataagtgggtttattgtcactctaataagaacatatttgcaggctaaaacatcactcccaggaaaatcaccgtgttgacatatttatcttttcttaacattttcttctaccaataacgcagtgtaagaatcaaccttaatagatcactcactttgtgccaagctctgttctaagcactctgaaaatattaacatatgcaattatcgtagccatcccacgaggtaaccattgttatcccatttttccacgtgaggacactgtggtaggttaagacacttgatgaaagctggtaagtggtagagatatataactgttaagtaacaagaacacaattttatttcttattttatttatttatttatttatttatttatttatttatttattttttggagacagagtcttgctctgtcacccaggctggcacacagtggcacaatcttggctcactgcaacctccgcctcccaggttcaagcaattctcctgcctcagcttcccaaggagctgggattacaggcgtgcaccaccacggccagctaattttagtatttttagtagagacggggtttcactatgttggccaggcggctcttaaactcctgacctcaagtgatccgcccgcttcgacctcccctaatgccaggattacaggcataagccgctgcgcccagcctaagaacacaattttaaatgccaggattcatacctctaaataaaatgggtgcatcctctacaaggcccaggatgtggtgggctctccctgggctgtgactgtgtcttccttgaattgtcttcagaatcattgataagtcccacgcctctgtttcctatctccattgtcacagctgatttatgaacacaaacagtattgcaaaacttaacaccaccactgtttgttgtaaatttacataccttgtgactcatttttaaaaaatcaaatatagcaacaaagtacaaagatttaccaccactgactatgtaagagaaggcactaggagatcttaggatattatgctaagtggtatttcaaaggcattttgtatcttagtataagatctctggtgtgcaattttgtgtgatttgaatagggcctactttgcaaggggccacgcagacggatttcagcatcagaattgatttataccagtagcctcttctttatggtcataccacatatttagaatttgaactttctctgatgcagtagactgcatcttgctacctgagaaagatacaaaccaccctcatcttggcctgaaaagagcctctcccagatgctcagcatccagtacagggaagaagatgatatggtatggggggtttggagccaaaaattgatttgagacatgggtctttgtgactctagcttagtgacttaacctttcaacacctctgtttcctcccctgtccaatggggagattgacctcacctgagagagtgtcctgagaaccaagtgtaatgatgtgtgttgaggggtggggacagggctggcacagtgcctggcatgttctaaccatctataattttattcttttttcccctccctattccattctctctgtggccccatagagaagactccaatctgtggttttcattgatggtggcagctttagccaggcagtggtttccctgttgtacaattcaatagcctgcatgcagggacatgcttctcaggtggcctctggatacacgtgtcctttgtggcctacagaagactttcttacacagtgcactgttaactgagcagaggcagccgtacctggggtgctgattagcactgtgcaatgtactgattggtactgtgtaatttttaggacctccttttgttccctacgccccttgggagagtgtggcacactggaagaaagacacgctgtatcctgggcacaggtcttctgttagactcaatggtgggaaggggatgggatgcagcccagggcctccctgcccatggcattttctcaggagctgtctcctttgagttgctatcaaatcgcatatgttgcatgcttacttgaaaggaatttgcacagagtggtttgtttatactagttaggcatcaaaaagaccattgttctcccagactttcagtataacaaacaaatttaaaaaaagtatgtatatttgggtagataaatatagggttgattcctaaagggtttagaaataaccacaaataggcccatttataacaagaggttgaaggagagattgccactctttggagccacatctgaatgccagaagttcccttgacatcctgctcagtccaagggtcacaacatgtctgatgcctagctctggactcaagggcatcagacatcagaacacgtctctctctggactcagggacaatacccatacatatctgtggaatcaggataccttacctcctatctccagttcctaccccactgtgaagctcagagtgatattgagtgagccctttctgaatcgggaccagtctcatctcagcttattacccgtgggccccagtaatgcaatctgttcaccttctgaacactgggatccccgttgtcttgtcctaggtcactcatttgagagacagaagcgagtagaggctgtaagcatgaactctgcagccacagggttgctttgaatcctggacttgacacagctgtgtaaacttgagcaagttattgcaactctgtgtgcctcagtttacctatctgtaaagtgaggatacaaatgatctacttcatagggctattttaaaaatagttaatatgtaagtaactattagaatgcctagaacacggtacttgttagtaagagttattcattgtcatcatcatagtcattatcatcatcatcatcaagaatttgatgagtacctgtaaaggctaagcaatatccgaggctcatggggtacacagcaataaactaggcagggctctgttctttgagaaacttactctttatttgagacaaacaataaagagagctcttttagcacaaggcactgtaggaattccagtaacaaggagtcgtcctatgtagacagaacttgtgcatcgttgatgatctcgacgatcttgctaaattgaagcttggatgggcaagtaagactcagactttactccaagcaattccaagcatatgaaagcacgatgggcagatattagcctgccatccatacacagtattggatatcgcactctctgtgggacatttgctccttattctgacatcataagaacagaaaaccagtgcttctggacacgaatcatttcagggctctttgcagatgcatagcatgaaagcagctgtttcagaattcaaaaattatacatcatgccgtatatggcttttcgctttacaagttgctttcaaacattgcctcatgttggcctcatgacatccatgttagataagcgtggtgagaattacttccctgtttgataaacggggaagctgagtcagggggagctgcctcatcatggtcactaaagagaggcgagtgagacctggaaccccactgggtcttctgtcttctgggtgagctcttggttgaggggactgtgagatgcctgtgtaggtgagtctttgctgatttatagactcaatggactaattgttgctggatgctaccagaactatgaaacaatctgcaggacgaaaaagcagatgagtcatgcaaattttaacaaattagttatgtttctgaaattaaaagtaggtaaagaacacaaaagaattggaaacaaggactcagatacttatatgcctatgttctttgcagcattaacaataaccaaaagggggaaacaacccaagtgtctatcaactgatggatggatcaataaaatgtggtatatccgtacaatggaatattattcagccttaaaaagaaatgaagttctgatacatgttacaacatggatcaatcttgaaaacactatgccagagactgggcgcgttggcttacgcccgtaatcccagcactttgggaggccgagacaggctgatcacttgaggtcaggagttcaagaccagcctgaccaagatggtgaaaccctgtctctactaaaaatacaaaaattagccgggcgtggtggtgtgcacctgtaaccccagctacttgggaggccaaggcaggagaattgcttgaacacaggaggtggaggttgcagtgagcaaagactgggccactgcactccagcctgggtgacagagcgagacttcatctcaaaacaaaacaaaacaaaacaaaaacattatgccaaatgacataaactgaacaaaaaggacaaatactgtatgaatccatttatgtgaaacatctaggttagctaacctcatagagacagaaaatagattagaggttaccagaggccagagggaggagaaatagacatgtattgcttaatgactacaaaattgctgtttggtgtgaggaaaagttttgaatatagatgttggcaatggttgcacaatattgtgaatgcatttattgccactgaattaaacactgaattaaaactgcttttatattttaattatacactgaaataaaactgcttttaactagtttattttaattatacactgaattaaaactgctttttactagttttatcatatatcatactagtttgttgttgttgttgttgttttgagatggagttttgctcttgtcacccaggctggagtgcagtggcgcagtcttggctcattgcaacctccacctcccaggttcaagcgattctcctgcctcagcctcccaagtagcttggataacaggcacccgccaccacacttggctaatgtttgcattattagtagagacggggtttcaccgtgttggccaggctggtctcaaactcctgacttcaggtgatctgcccaccttggcctcacaaaaagctaggattacgggcatgagccactgctcccaccctcctactagttttattatatcattttaggttattataaaatcacagccatagtaacttcctgtgaggaaacggtttaaaaatatgagagcaggccacatggccacctaaggaaatttatacattttgagaagcgtgaaagcttattctatttccctgagaaaaggtattgatatcacaatgcagaggtgatcttattttaatttcagcactattactgctgtgcatttattacaatcaggcagagtactgatgtgtttcgaatacgggaaagacagaatctgaaaagagatagcaatttaactttctgcaggaaaactccggcgtgtttttcattctgacaacttgactggtgataagaaagatgaggtactacttttgtaaacttgttatccttacactctcaagaaccatttgtcatccatttttccctgtcatactgaaatatacctctaagaaaatatcggtaatttctcagtattttaaaaacatagattctcttgatcagtctactaaatatttcatagtttgtgtgttgttcattagaaaagaagagattccattttcccaaactgtggaactgagcagcgcactgagattttaaggagtgggatgtgggtaccctgagaagggacatggttttgtccagagctgaggaaaagaaaaattgaccccgagatcccagcttagccaacagccctgggcaatttcatcagcttcctatatctcggtgtagccacgagcaagatcattttgtggcactgaactcacggtctgcaactcatgtgcattcaggacagacattgaggcttagggtcaggctgtaggtggcaccagccatcatgggacattcagaccagagaatgcagcaaccaagagcttgcttaggtaggcaagcaggagcgtttgtccactccatagccagccttcatctatcaggggacttgaaatgttcattgcacattcccctgtaggcaagagtatttattgagaagacctgaattttaatgcaaagctttccaaatggttgtttgtagccagttgacctttgagtccagacatcaggtggctccattcctctccagggccatggagcttcactgtgaccttgggggactgtccagccctctccatagtgttgagggagcagctccagctcttctcccctcactcttcctggcctccctggggccagtatcccattgttaacaccagcaccagtcccatgcctatgatttcttcttttttttttttttttcttttgagacagtctcactctgtcacccaggctgaagtgcagtggagctatcttggctcattgcgacctccacctcctgggttcaaggaattctgcctcagcctcccgagtagctggaatcacaagcatgcactaccatgcccggctaatttttgtatgtttagtagagacaggggttcaccatgttggccagactggtcctaaactcctgacctcaagtgacccacccacctcggccttaaactgctgggattacaggtgtgagccaccgtgcctggcctatgcctgtgattgctttacttcagaaaagaaagcatgcagtgtctgacttctgagcaaagctgtggctcccaacaggaagacatcttacaaacgcaggagagatgcaagctcacttagaaggggaaacgtgcttagttaatgccagggttcacatgtgaccatgtttaaaatgaccacagagggaaggagaacaaaaaagcaaactttgctgacactcaaatgttttctgtttctaagtggatgaccctgcctttctagatacaacgggtttcattcttcatgctgggcaggttgccggggtttggacaaatcctgctcagtgcaaagcatctcccaaggtaacagtccctgctggctgctttaggtaaatgtcagcttgttatgctgctggacagatcccacgtgggccctgttctctgtcattgccatctattctccaagaattctgtctcaatgagaagaaaaacagatcaacaggggagctgaggaatagatgggagctgcgagctgcagagggccaggactcggtgtgttccccacagcggccatctgcttggcttgtggagacgaccagctcggccacacttctgagattaggactccctgatgggccagcagaaggggctcttgtcaaatcccactttccctgattaaaccggaacaggaatgtctggcagagtagaaaatccagggaggagaggtgaggcctgcatcctggagggaaggttgtcctgagatgttcctgccatttttgtccccaaaagcgggatgatactagaggcgatggggcaggatccatcctgaatgtgtccggagagttttggaagatttgaccatcactgcaatagtctttcttctacagaaaataagtccggtaaaaatggggcaaaagttactcccacccagaggaatgagacatatgtgtccccctaccgaggggtgccccagagagtgggcacctagaagatctggttgttccccgcagtcacatacctccctgaattgaagtccttagagccacagaaaacttcctctggttttcttactagttactgttggagagagggtcattcctgattcctcctccagtgcagcctggcaggggagcctgctgagctctgctgtgtgaactttctgcccagagacaaggacagggatgagaggaggcagcaggtgagcagaagacaagacactggaagataagacctgtgcatcaggaccgagggaatatatgtgggagagacagagtccactgagatgcctcagctacccagggttcccactgtaaggaagccaccagtgtccagaggactccaggaaaaactcggatcccactttctgctactgaccagctgtgtgacctcagaccaggagtgcaatctctctgcacatctgacatctgtgtcaattcttccttaggagaggagagacgatttatgccttacccacttcttaaggcagtgttgaacaatgtcatcatgtgtaaaagcattttttaaaataagctgttgtctgcatggaggccatgattcatataaagcaatttgatttatacaatgaatctctccaagttttgctccttgcaaggttctgtgtcaataaatgttcaaacccatatttattgagcacctactataaataatcaggcgctgttttaagcacttctgatatgctggtaaaaaaaaacagatgcaaatacctgcctttgttacgctgacattctagaggacatttaaagagatctagttccatgtggatagagcaaaatgaaagggaaagttatactttagcacaaatgtcaatttcagaatggtttatttttaaaatgccagactctgccatcctgagattgactaactattgtctcaccatctctttgtcctggttaagttcagagaatacaatgtgcccagagtgcagccctgtttgaaaaggacggcttgcagagttgcagcaaaagtcatttctgggcagacgataatactaaacggaagctgatgaaagaaagagaaaaaaataccatgagagaagggggatgctggtgaaggtaaaatgttagtggagaggtagatttcaaatagaatcgcctaggttgaaaataaaaagcagtcatcaactatgatggaaaaatatttccgagacttgataagtcatccggaccctggctgctcactcccagggttgcgtgggatcctttgcaggatgagcagaggctgtcagtgtgggatgcgtaacacagcaggcacagggtaactgatctaattatgaagagcccttcccatctgatcctgactttgacctatggcttgtgaggccccagcaacattgaatccagggtgaaagtcagaaggactaggacccactcagctagttcaatcctctcatgccttcagtggctggagatatttagggagcacatcctatatgctaagccctaaataaggtgtcaggaatatagcagtgaactaggatggcaggtcccttccccaatgaaacccagtgtgggacaaaatgtgatcctggaaggtgagggtgattctgcaactcataaataaactgcgtgtgccagtagcaggccttgtggtaacacctaggcaggaccaccttctctgcacaacttcagagagcataacttaatttttacacattgaattttgatgtatttatttgtcattgcctaacatcccaaccccagcgtctgatggggatggcagtcctggcgttatgccatgggtagggtactgaggctagattccctgaatcctgaccgagtctcatcccatgagccagggtgatgaggctaatcaaacaaggaaccaaggagcccataggttgaaatacaaggtttggaagaaaatgtgatgcttgctggaatgaccagatgggcgaggatgttgaaaaataaatgaggtgtgatcattgcaattcattcccatcattacgaaatcatttattattaagttacacatggacacactgcagtgccaaggaaaagtacaaatgaaaggtaaaaacaagggacaaatgttgctcatgttgccagtaccttgttttgagtctggaagagaattatttatgttgctgcagccaaacgtctctaaagaaaatgatcaaattgtaattggtcaacatgttctctcaatgataccttgatacatcattttaattttaagtttttattcatctctaatgttttacttcaggcacttcttatttctttcttggaccattccaaaaatgtcctaaactggtatctcggccccagtccatcttctacgctctgaaaaaatacctttggttttatttttgcagagtcgattttttcccttcgtggatgggctccttggcaatctgagccttcgccctgctccctgccacccccctgccttgcactccaggcatgcacattcatgaaaattcctcaaaatcttagggaggctgaggcaggagaatcccttggacccgggaggtggaggttgcagtgagccgagattgcaccattgaacgcactgtagcctgtgtgacaagagcaaaactctgtctccaaaaaaaaaaaaaaaattccctcttgctcatgactcatttgtatgtgatgttccacttggcagccattttcctctagtccactggcccctggtgttcccgcggggcttcttacatgagccattctagaatcgcaggtcccttgctcttcctctgcacatgcctgtgtttatctggagagagtctgtttgtttccctgtttgccttcttaccagacttggagcccttcaaagccaagggctgtcccatatggatagaccttccccagtgtctaaataggaactgggatatgatagatgttcaataaaaattaaacaagagacaaaacaaaagtagggaccaatctggaatccagtaaccatctctcatttcaggagaagtggaaactctcaggaagttgaaaatactgggcttcagaacctgacctagtttgcagccaccgctcccctccaaaaacaatcccataagaattccttctgacccctgagatgagagggtcactgaggtggatcctggccttggaaatccctgttaggacctattgggaccttttacttgcccatcaccaccaccctaacattacattagaaaccaacttgggcttgaaatggaggcctctgagtttgcatgaaccccaaaatgcaggctcagattggtttcattgcaaaaagggaagttgcattccagttatctctgaataaaacttgtgatggtaaggacacagcccctacccctagaagtgaaaactggcaagtctccaggaaccaagaccactccaaggtccagttcttgcatcagcgaggccttgcttccttcttgcttcttaacaactggattccatgctcactcacggcttctcctctctctacctctggaatgtgcattgctgtcagagctgctttgtaatggctgcgtcctcatagcctagactctctctcctgagctttgaagcttcagtctgccctgctagccactaacagactcctgaatttctaagttcaggttcctacaatggaaaataagattgacctgactcatttcttcatgtggaatttttggctacagattggctgttgtttggtcaggccacaaaccccggtccaattgaccatgttttaccatattctcatcttgtccttagaaggttgcacagaggtgagttactgaccagaatgaacctaggcatggacatttaggaatttcctattaaacataaacacttcagagaagaaaagcatattccatcttaatacctcagaataaaggagcgtatcagcttcattccttttcagaggtacagcaggaatctatacacatcagggggccagttaatctgaaggatgagggggacgtctgaaagcagatgaggagaggaaaggaagaaggtagccctgaacctctgaactatgttcctggatctcgtcaatttagtccttactctctgtcaagttgatccattgacagattctcaaaaccaggtcaatatagagatatggcactcttacgtcttgtgtcagctgtatctgttatcaatagttttatgaatggcaccaccgacaaaggataaaaacctaactgcgattaggcaaggaaaatatatatataccagattttctggtcccccacaagtttcaccctagtgactgttctctgtcatcccacgcagggtgggctttgagaactcatcaatcctcttgtgagtttcagtcttgcatcttttctgggatctggctcaaacgtggctaatttcccagcatactatgttcagtacaagggcaatctgtcagcattcgtctgagcatgtttgtaaagacacataattcactatgaaaccaattcatttcagatgtgctttttcccattgcaccaaagccccgggttgatttggcagtttggtatattatacaaataaatatgtcgaaaatgggaagttaacaactgttggaacctgaggtttctgaaggacttggctctggtgtcaacttcagaaggtcatctggagaagctaagggatctgaacattcttaaaaggaagagaaatgctttagaataaaaggaatcctgtgtccacaggcaggcagagtctcgtttttgatttcctagggaacttagcacagtggagttccaatagctcataggaaatcgcgtttcacaaaagttacacaaaacaatacctttctgaggagtttatgttctaataggaaatacctaaaatatatttatccactttttaaattttattctaccttctctcttttaacactgatttacataataagggacagattaaattaatttcataatagaaatcttgggctttaaaaattatcttagaaaggtaattgtcttcatttggtgttttatgttccctaagtagttatctttgctgtttcttgtgggggttgctggcaattctgacttcccattccatatctcatttattacttcatttaggaaatactctttttttaatttgataggctgaggtctatttcctaatgactttcacctagttttaattttcagcaaaagaaacacttaagatataagtcataggtaatacttaggcctgtctgatgaatgacggaatctagcttccgctggtatttcatctttgacttctaacatgtaagaagccttcactttagtggtcatctctcctcctttttcgtccttgctcctttcagaagtgttcatctgtagcgtaggattcagtgatccccaagtgttttaagctgcagagctctttgttccgatgcttgtaattcacataaaggagataaaagtggagctgtgtgggctgaaggatgagaaggggagaggggggaaatggagccccaagttctagacaagcctccccccatcaactccttcatcctggcagcctaggaaaggttactctagcacaatttggaaacatctggctgagtcattttggcccacattttctttctgctgaattcatttgcattctcccagggcgacatacataaatgttttctagttcatgttgacatctttcagttattcatgaactgtgaccctactaccctgtgaggttctatgagaagctctgtgtgttgcaattctgtctgcattgctttgcagatgatgagttgcctaaaatgaatgaactggttctgacctatctaagtgtatcacatggagatgctcttgtctcttgatttcagtctaggtgacactcaggttttccaaaagttctctccctgatacacacattatttcattgtttcctgtgtgctaagcgcacacaggatgcaaagatgaataagaccttcccttacggagccctcagcctagccatgacgagagccagttatggagtccctactagatgtccattgctttacatagtttctatctcattaactttggtgcacatagccagtaagcgaaaggacccgggatttgcaaacaagaaattattctgacttcaacgctcattcctttcactgatgggcaaccctttatcttacctggtccctgccacggagaaactcacaggcagggccgggcagagaagtggtcagtgatgctctaaggtaacaagcacttcccataagcctggggtaggaggtgacatttgcacggggcactaaaggatgattaggagctcatcaggtggaaggagttgggagtggggctggagctggtgtctttgctaatgccttctaggggaagatgccaagtgttttagatttccattgcttatacttatctccagtttttagtggcctacttgaatgtcatttatattgtcatttacaccactccccaaggccaaatcatatctgtgttgcaaagttggccaacagggattgtatgaactgagccttctctggagattttctgcatgggtctgttagttcatgtatttcatgttgagaataaagtatgggcacgtgaaggtttgggggatattttacataagacattctcctatgtaggcatgaaaatctttcctgactccaatcctgttgctaaacagcgaggtctagcccagaaggcatggaggggagcagagtttctgggaaacaagaagaggacttggagccccagacaggggacaactccagagggtttcttggggatacctttccctacaggccactgaagacagcacggcagtggaaacatctgcatcacccaccctggtgtgtgttcccccgacaatctgtgggcttgttccacagctggcaccaaattctggctgagcagacagccccagaaatgtcacctggagccgttaaaaaaacataaacaaggcatctgtcacgctgccgtcgccaaggtcatctggtggcaggaggtgaccgaggaggagcatggtggtgccgtgccatcgagggccaacctgtgggcagacctgcctgtgccggcgctcccttgctctgcagatgcattcaaggatgtgaagttgtgcaggggccagacgtgagaagcaaaacaacctgaatgaaatccagccactttggagtgaaacatgagcattttaaaacatgattttcaaactgtcgcagggttagtattgcatctggtctcctctcatgattgcctggaggccaccagcccaaagctggagtgagacatgagctggagggtaacctgaacaccgaatttagggagtgtgttgttcatacaaatcactcagactgagagttagagatgggatttacacccaagctatccatcaaaccactatctgtgtgaccttcgacaacttatccatttcctctaagccccaattttcatatctgtaaattccctcctaggatccttgtgaaggttagataagatagtatgtgtaataatgcagggctgcagagggccctcagtacattttattttggctttctctgccctcacttacaggtgagggaacagatttagagacggggagttcatagcataccagcatcaatgatcctagcaagaactgtcgtactttcttcctccttccttcacttcctttttccttatttccctcataatccactccccttcccctccctaccctcagtgcacatgatattatgtttgatgggtagcttttggtttgtatataattttggcaaaacacattctttgtagaaatgtattctttaatttgttaaatggtttgagtttatacatggatgccttatgtgttttgtgcgtatttacatttatatttagattcctcttttttcttaagtactgtgtctatgttccctccctgttgctctgtgtacacataatcgattgcttattgctctgtgtatgcataaacagttgcttcttttttttttttttttttgagacagagtctctctctgtcacccaggctggagtgcagtggtgctatctcggctcactgcaagctctacctcccaggttcacgccattctcctgcctcagcctcccgagcagctgagactacaggcacctgccaccatgctggctaattttttgtattttttagtaaagacggggtttcaccatgttagccaggatggtctcaatctcgtgaccttgtgatccgcctgcctcggcctcgcaaagtgctgggatgacaggcgtgagccaccgcgcccggctgccgttgcttctaattgctgcttagccttgcatggttgcatccagtctgttccacaaggatggacacccaggttgcctccacactatccccatagtccatcttcttgtaattcttaagataggaccaaaagacatttatttacaagtttccctcttctattagacggtgagacagtgagagaagatttcctgactttatatacaaagcagctagcacatagcagtttctcagtaaacacaaagccattggcttcccaggcagctggacacatgggctcaggcccagcctcctgtgtccttggttcccaggaaaagtgacagccttaacggcagcactgtgattaccgttatcttgtcatgaaggtttatgacgagtaagggaagtgccttttaggaagagaaaagatgaaaagccttcccatgtgacgtatactagaattccctgaaacctgaaggccccacatgatgcacctgtttattcaaacacatacatttgagtactaactgtaagtgatagtgggtatggatttggtgaactctttgaatgctttcagcatttccccaatctgtaggagattctagttccttagaattggatactgagccctgtttgatgaaacttgctgtggcatttggagaggatgcagctagggttcacacatttaaccatggatggatctgtcagtcagtctcagttcatggtagacaagaaaggagatacatgctgacaagccgtgtaggaagtgtactgccttaagcagtgtaaacatctttattcctgaaaggcatatctgctaggttgattgtgaaatgtattctgtttttttttttttgttttgtttttctatttggagggtgagggatagcctactttaatatcagaagattttttttttattgaattgtggtactgagtgaaatgacctacctttacttgacctgcaacagagttgctgtagaccaggggtgggcaaattctttctgcaagaaccaggtaataagtattttacactttacggctacatggcctttgtcaaacctgtcacctctcctgttgtggtacataggcagccattagacagtctataagtaaatgggcttagctgcattccaataaaactttattcacaaaataagaagggggccaggtttggcccatgagccctggttttcctacccttgtttagatgctcatgcacttgctacacctggaaatcaacataaatatagtaggtccaataaggcaaaccagctactgtttcttgccagtattctctgctctctcttcaggacactctgaacacaatggataggagtaatatgaacagaaaacagaagaaggacttggactgtatcaattttggcttggttgtgcacgccagaaaacctaaaataacagtgcccagtacacagcagaagtttatttctctttcttgtaaatacagtttggagacaagcagtccagggatagcatggctcctcttctcacaaaagcctctgctccttctattatgttttctcccacgaagggtttggtctcatggttccagattgtagcaagcattccagataggcagatgggaaaaggcgggaaggagagggagagtaaatgaagagcgtgcacgctgacagatgctgcgacgagcttttccagttgctgcctgtcatggttagttttaggtgtcagcttggctaggccacggtacccagcttcttctcaaacaccaggcgacatgttgctgtggagttttgttttgaagatgtgattgataattcagttagcggacatggagtagagcaggtccccctctaccatgtgggtgggcctcgtccgattagttgaaggctttaggagaaaataatgaggtctcccagggaggaaaggattctgcctccagacagccttcaggcttgagccaccatcccaactcttccccgggtttccagccagctgccctgccctgcagacttcacatctgccagcccccacaatccaccatccttaaaaatctgtctctctctctccacacacacacatacacacactattggttgtgcatctctggagacccctgctgcgtgtgcagcctattcatctagaaggctccggggcagtgggggatctactccttatccacagcattctaatattctggagacacaagagaagggacatggaagggcaggcagacattaaactacccagaagcgatgtgtgcctgtgctcttattgcacctccacattcttatttttcttactaataaagaatttaaaatgaaggaagccccagatcacccgggtgtgattctctagccttttcccacttctagttcaagagatgtacccgtgttcttttaaccaaagaaaaaatcattgcatcctttactctagcagtagtgcctgaagcatggggtgaaggtgatgagtgcgttagggcctttgggaactctgtcccagccaaccctcaccgtccataccctgctgggagggaaagctgtggccccggcagctctcttggtttatactcccaagaggaaactcttcctctcgaagcctgggggagggacagactttggaccaagttcactctcccagctataatttgaagtgtggacaaaatgggcccagatgttcagccttgcttgttgggcctggctctggtctgcgttctcatccgcgagaccctcggcctccctgcccacaccaactcgccttgggtcttctttgagacattcttactgaacaagaaataattccccagggttagattactggacacaggagaaatgtgttctgcaagctgaggagaattgaatttggcttcagggacttcctcctccccaggtgaggtttaccagtctgtaaggatctcacaggtgatttgggtccatttttggtgcactttatttctcttcctagaccctttcctctgtcttcccagacccttcccctcaaaggggtgctggcgttgggttgcccacggctccttgccccggtgagccctgaccacgcagacccagcagcttccagggacctcagcatttaagtaatgggcgtgcaagagaaaaccaaaaccaaacccaaacaagcctccaaatgcagggagaactcctcagtgggagctggagagttctagttgaaatgtctgaggtgacagtgagcacgcagtggtcgactgtcggaaagctggtcctcaggccagaaaactcatccacagttccatcccaacttggtctttttgtatgagttgaagaaaaagtgtgggttttttgttgttgttgtttctttctttccaactagtttctttggatcctggcatgactccagaagaatcgtaccctgctgccccacattcatttttatttttaggggattgtaagttagaagaagtgacttctcttgcagatggcaaagacttacaatccaaaatcatcacaactcacaatttaaagacattttgatctctaccttcctgagcaaatcagccggcaggcctatttcttgtagggctttcgtctgcacatagtaggtcctggataaacacttgctgattaaatgatattcgaagcaaagcgactgcagctgattgtctacttagggcaaggtgagtgtaaatcagaagggtgagaaattgcatcaggctgcggagggatgcaggcttgcacggctacaaacaaacctaattagctgtgcctctgccagcagccctactcagacacatctggaggggggagaatggctaaggctagattggctttcccaagtgaaaacgcctctcttcagttgcacctgcacaggactgattgcgcctcaaatccatttgtcaggctggttgcaggtatctgagaaattgctaatagaattgggcaaaagtgcccgtgggagtgggaggtaaatagcatggcaagacaagcggctgctggagtcccgggttggcaggtgggcctgcccccatgccccgccaggctccagggggtacctatgcccagtgactacagagaagacccgtcttggctgagcatcaggctctggtgcagtctttgctaagtgtgtttatcggccaccacgagagtacttagctgcaaaatggaggtgctttcactcacagacaccaggagccttcactagggaggcactgagatcagcactttttccaagatgctccttgcaaggtacttgtgctccatcaaattgcaattcttcctagacacaaagggaggcactggcccagagtcaaggtcatagcaagaccccttgagctgcctgtttcttagcagaagctggagtagacagacatgacttgagacgtcttaaacttgtttggagaatttgggactggatctcccgcccaagcactttggaggggtctgaagagacacaggacgtgtgtatacgtgtgtggggatttggggctgtgtgtgtgtggggttggggcaagggcttggatcaaacatctggatatgaataccaactctgctgttttctgctgactgtgaacttggaagagtttcttatcagttcaagcctcacttccctcataaatgaaatggggatagtaatcattattatgggctgttgggtcccccaaaaatccatgtgttgaagtcttaacacccagtgcttcagaatgtgatgatatttggagatacggtctttaaagaggtgaatcaagttaaaatgaggtcctatgggtgggccctaatttaatatggctgatgtccttataagaagagagattaggacacagacacacacaggcgatgttatatggtggtttagggtctagactgccaaggttcaagttctgctgtgacttacttgctctgagtgaccttgggtttcatattaaattttctgaatatcaatttcctcacctgtaaaatgggggaaataacagtctgcctcatggtgttgctggaggtgtgaggtcagatattaaccatctggcacttccaccgctgcaggtagcttggccattgttattgttatgattaagggcaggtgagcatgtagtgtctttctttgctaagtatgtctgatgccaagtcagtattcattgagcacctcttctgtgcaaggcgcttggaaaggagtgcagtggctctttttccccactcttgcccctgctagattcatcctcaagtcttctctgagttgcttttcctgcagcccgtagttactgaaaaccataatacttatagatgctgctttctagaaatgagcctgtaaagtcttgtattttctcttggtctgcacaactttagggggggtaacacgtcctgtatttgccagttgttaaccttctctttgaccacggagctctagatgatggcaccgataatgcccaggcagatttagttttgatctccaatgaaagataggcctttctgtatttgcagtaataagcaaacacctttagcttgagaggataaacttaagtacaatgtttgttctctggaggcatactgattaactttaaaatatgaataaaaggcagtcctatttcattatggtaagaacacttaatacaagatctgccctctttttttttttttttttttttttttttgttggagacagagctctcacccgggctgtcacccagctctgtcacccaggctggagtgcagtggtgcaatctcggctcactgcaacctccacctcccaggttcaagtgatcctcctgcctcagcctcccgagcagctaggactacaggagcgtgacaccacgcccggctaattttttgcatttttagcagagacggggtttcaccatgttagccaggatggtctcgatctcctgacctcgtgatctaccctcttaacggatttttagtgtgcaagttatctgtaggtacaaggttgtacagcagatctgtcaaacttattcatctcacataattgagactttatgcctttcaattagcaactcctcacctcccgctcccaccagtcccaggcaaccactaccctgttccttttgcctccgtgagtttggctactttcaaagcctcatagaagtggaactgtgccgcatttgttcttctgtgcctggctcatttctcttggcatctttcctccaggttcattcatgctgtcaccaatggcaggatatctcgctcttttgtttttaaaaacagccaaagtcaagtatgtaaaaaggtgggcagctgagaacctggtaccagaatgttccaaggaaaggtactgagtggcacaacctggcctggttctccaccagtaattcctaaacttccccacctggaggctcctgatgacagatgggtgaatggcagagtagatgagtgagggaggtggggagccccggtggggcctggctggtcaaagtccaagcaatctgatcccagcaggacattcctttgaaggatcatgtatcactttacaaatatccacaagctttgcactctatccatatttgtttaggtgtaaaaaaatattttaagctctttactgagaaggaaaatgggatgcacccacatggattccccagcatgcaccgctgagcattccctgtggtaccgctcctcagtttagggtttaggtcaggggccctggaatcattgaaggagacctgtcttcctctcgtctgctgtcttcctcctggatatcacccctgggtcaagcccatggtctcagtgggttagcaatgaatccttcctaagatgcgaacagatgggagctcaacatttgacccatccctggggttttagtttttttgtttgtttgtttgttttgagacggagtcttgccctgtcacccaggctggagtgcaatggcaccatctcagctcactgcaacttccgcccctcaggttcaagcgattctcctgccttagcctctcaagtagctgggattacaggcatgcgccgccacgcccagctaattggggttttaggtttaagaggaatcccagaaggacagggtgatctgaggtcctgagcaactctgaggctgaaactgcgctggtctactttaaggcaggggctgtgattttccctgtgactgaggtcctccaggggtcaactgcatttcaggtgtgtgaggggagagtgactgcccacctggctacccagcccttctttctgagcctgtttactcagctgctggggcctccatgacaggtttgcttggtgaccttacaccgcagtggctcccagggccagagacgtgaccaaggagggaccttgcactgaggaacctgtgaccgtaggaagaccctctaaggccgactcttgcttggcccggcccagtccctcctaccaacactgataagaacttaggttcctagcatcccaggaggcagggtcacaaagacaagctgagaactgataccactgctatacccacccctggacctccctgtcccatgcaggagtctaagccagtgcaaccaaggccaagcacacacccataccacacagcaagggtttcacacggggttttcatttctttacccctggccgaaccatgcaagctaccagccatctacccagacttcttagagtctgccaaatacgtactcagaccagaattaagttcaggccatggtagaggtgaccagccactctgccgtgacctggattcagccatcaattccaaagaagcccacagtgccttgcattttgctggctggtttgtttttgtaaaatgatggggtgggaagcagtgctgggcattggaaaggggctgaacaaggggaaatcttcaacaccttttaaatggaagcatgtctagttggcctcttttctgtaaggaactatactgggcatcacagagatgcaaagactagagtgactgattcaggccctggcctgaaggactttattattgagagttccccgtatatataaatggctgaactctcaggccagtgaatgcctgtgaccaagtgccaatgggtgaaagtagaggttccagaccaggagtgggaaatgcatcaacagagagcttggccacatgctggcctggagtgcagagaaagagtgccaggcctctgggcactgagttctgagctgcttctggagggccaggagatactcccacctgcaaatgactggctgattgcactttccttagagtttgccacctgcatttccgctctacccactaactgactgctccggtgcagggagccaggcaggggcagtggtacctgggtcaggacacgacagcagcctctggcctcaggcagggagtgctggacagtccgtctcctgtcctgctttgtctctttctccttgagctcaggacacagtggggagccctcatgtttctgtaaggtcatcacacaggctggaatgttttttttttcctctctctctctccctgtctttcttttaatggacaaacacccttgaggtcctggttgattttcttagagaaatgtagattctttgattctaacgatggaacataagttttctgaattttgaggaaaacaaagcccaagatttcaacaaccagtgttcctgccaaatccactgggcaaacagaaaagctgcctgcctccggtgctcccagacccccttccttctcaaacacgcatcagacactttgcaccaagaaaaaacaaagggcatccctcctggggccacctctgccccctgtccaggtacgcgctgtctggcgcgccctgcgtgggggccgcaggttcagacacccgggcgcggcgcggggccctgatggatgcggtgaccgaggctgtggctgcgggcgcggcgtctccgcggcagtcgctgcctccgcggccccctccccagccccagccccagccccagccccagccccagccccagccccagccccagccccagccccagcccggctgagcgggcggccggagcatgcgccgtgggcgccgggccgggaggcgggcgaggaggcagcgcgcatcactcgggtccccttcctgcacccagccgccacttgccggttgctaagcagttatcattgtttctgtggcgattgcagaggctgttgctaattggagaagccccactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggtaatgctgcttttgggggtccgtgtgtgtgtgtgtgcgtgcgtgtgcatgcgtgcatatgtgtgtgcatgagagagacagagacagagagggaggatatgtatttggggaagaattttgtattttgtattggtttatgactgtagccccctgagccaccaagctgggaggagacgtagagtgctgggtgctgctggagtctgcggctctcctctccctggcttctctctctaaagggcgccctggcttgatgattaaggtacaggcacagggaacctctgtcaaggtaaacttgatgtgaaacacctctggacaaaggcctctctctacagagccgccagatctaacgagttccctgggaaggttcccagctagtactttgtaacttgggggaagagggttgtagccagaaacatcagcgtattctgaccctccaacaggactttgctttggttctaagacaagtcaaagaaaatgagcttactgaaaggacttttctttggatacctcgtggccctttcctcctgtttccctcaagagcaaactgtccctgctagagaagccgaaggatagacggtcgggataaaggaggactcggccgagaaggtgcaggtttaaagggctgaccgcggacggggaaggctgcgtgggtcccacatggcacagggcggccgctcgccttgtcctgagaagaccacggtctgcagaggcccaaggggtgagggaggaaaggtgagtcagccagccgcttcaccacgcgtgtagacatcgtaattccctccttggaagatcttgagggttcttgtcttttaatcattgctcagttcacctcaggcagatcattaaaatagatcctgggagacaccaatagattcacaaagcagtttgctcaagcgtggtaaatcaacagcttaagctgacttctcctatttattttagggttgctgttggatctcatttgctaggattagggcaaagataggcgacctctttagagttcaggaagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatataccttgaggagaccttacctggggtctgaacacactgcttagaacataaagaggtaaataacctcctaaaataaaatccctaaagacagtctcttattcctgcattatatataattttgaaaggtattaaaactatgctgtgtgcttagactgcagaactcttaatgagttctccattctttattttattttattttcctggttgctaatgaaacttcagggatacctctattcccaggctggtaggcatgtgtagggagaccaggaaagaggaatatgtttctttttttttttttttaatttattttttgagtgagagagaggattgctgctttgtggattggttttgaagcagggggtcattaaactgtgctaactcaatgactgcctgcaaatcaccaagtgttgattcttatgagaaactcactggcacctcacatcctcatcttgtgaggcattaaccagagaactgggattgaatggagcctgatgccatctccgacatccttccagctgtttggttactgcaatagactacccattacttcttagcaagtgaacagaggaaagtgagtttctttaccagccttggtatttggaaaccaggcatatgggtggtgggtggaaataatttttgtgtgctgaggatggccacaaattaggggggaaattagaaaaaaaaaagattttactattagttagagattgttgttttttttctaccgtgtttgctaaaaaaaatgtgtaaaaagagtattttgggatttttggtttgttttttaaaggatactaaataaacaagccagagtaacaaggagaattggcttctgggagactatttctctttctctttggagatgctaaagtttatttttaaatgaagtattgcaaacccagagatgtttggaagcaatatatactttaatctgcatgaactgagttgatcctttggctctgaagccaatcaggtgatactgagactcctcggtgaaaatggctgagcattggctgcacctgacctctgctcctgcgcagagggaagcctggtgagggacccagaaaaaacactgaggcaagtctggcttaaatttactatattctcacaagccaacggagctcttccttagaaaaccaaattaagggattttttttcccttaaaataaataaaagtacaaatttattgtagtacatactgtctccatttcaaatgatttaaaattgaaaagcagtgatcagtaaagctattaagagaagacgaaaaattaattccctctgcttgcaatgagccaggacacatttttgctcaaatattaagcagggataagtttttcctagcatattgtgtgcatgtgtatgtatgtgtgtgcatgcgtatgcacacacaaacaaatgcacacacgtgaacagtcacacacaggcacacctcgtgtgtcacaaaatcagagttggaaaggaccccacacatgcactcgttggtcctagttcatgctctcgtgctgaggaatctcacaaatgtgtgagaatatgcctttcctcaaaagatctccagaaaaacctcctttcacatggaaatagcctacattccactggctaacttggatctttggttatatgttcagtcacatttttaacttccttagacctgaaaatcagctgttctcatcacaccttgtatatgtgactgctgttttttgttgcttctcagttttcttcaagttgtacaaatcctgatagataactccccatgtgtctgttcttctattaaattatgagccccaggacctagtattaacttaaatttggtgtctgaacatatataataatgccattacagaagaactttttgaaatgaatagaaatttttaaacaacagattccatagaacggacattgaaatgcatgtgaattctgggagaggttaggtggcctcccggaagggcacataggtaatggcccagtaagagaatttctgatgttcctgtccgctgctctctgattttgatcttgttgcttcttgcagtagatactgaaagagaggatctaactttgaccataatgagagttaaattttttatgtagccatattaaaaggcaatgtgagacatccgtatttaagataaatgtggtaacaggaaaaaaaagaagtgaaaagaacacagaaaaacaagattcaatattaggaagtgcacataactattgaggagtcccaatagggaaggtggtccttttgcagttcaaaaagggcatggggtggggttggtggccctttcacagttcacacggacattggatgtagcagccatgctcacgtacagtaaattccatctgtgcatggtctaaattatctaagactctgtagataaaaagaaaacttgaaggaactgctgaagaatagggacaccaggttcttaggattgtgtagaagtacatctgggactcatggacttccagagccgggagacaggatggagtttggctgcaaaataggctgatgtgtgaaggatttgaggagagaactgggaagtcttggatatcctacagagagcaggtccagaaccagagctccctactgggaacaccagagtgggtccttgagctgatggggagcagcatggagtctttggggaagggaaagagcttagctggtgtggtgctatcctcagaggagggatgttttgcttgttaccaaagagaacaacatgatgaggaagcaagcacgcaactagcctggaggcggcatgcgctgtgctctgagaactgacaggtagttcacaatcttttgggatccgtgtcaccaacttactaaaaagtgcaaatcagcaagtgccatttagcacatcaaatgaaagcccaggcaattgagagcaaggacaaatgatacccagattggcttttggtgcaacccaaactcaaaacaatggaaacagtgtttctgtttggttttgttttttaaaatgctttctctgtgcattaaatgcattttgttattttattctgacattccattaaaccaaatccagccccctcattctcaatactgtggttatcagggcagatatactcaaaaccttcaaatgctccatggagaacacgtgagggctggagggtgcttttcattaaccttcaccgaaacatcttagctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcaacaccagcctgggcaacatggcgaagccccatgtctagaaaaaatagaaaaattatccaggcgtggtggtggcgcatgcctgttgtcccagttactcaggaggctgaggtaggaggatcacctgagcccagggaggtcaagtttgcagtgagccgtgatcacaccgctgaactctagcctgggcaatggagtgaaaccctgtctccacaaaaaaaaaaaagaaaaagaaaaagaaaatctgggtgggatgtaaattgcaatcctgtttgttggtgcaattctgcatgtggctgatatcctaaagtccttcctgactttgatagcatgtgtttcttgaagtggggagtggagaggtctcaacacacacagcccaggtagaatgatcaaatccagaaagtttattctctgtcctactcccatccccatttgttgttgacctttcaggactctttacttctacatcccgggtaggcccttaatctccactggtacccatggtttagcaccattttctcatacttgactcttctatcaaaaatgctccatgtgcttttccacctgggccttgctaaatgactgagacaaatccattcattaaacaaaaagtgtaaggtgggtgtcatgcagtactttcctgagagcatttgcaatttcaacagtagctattggtgataaaacccaatgcaattattaatggtggaaatttcaggcacaaagttgtggcaagacctgatggaagaaaaaatatttagtcacatcgttaaggaataatgaaggtgaggtcacagcggggacagtcttggcaccccttaaatcatcgacaggctgtgcacatcctggaggtatctgttcattctgtgttcacattagagctggtcttgtatcaggcaagtaccaaattacagatcctgttgctgctttctgctttcaaatcctgaaggatttgatagtaatagtgttgaaatgtgcagcgattccttcttaggaaaaactgccataatatgcacaggcatggagtcagtgctgtgggtcccctttgatcctggtggctgggatcctgaatgcagccctccaccaatggctttacaaagcacgttgctgatataatgaagtcttgctccgcaaatttttagtgacaatgtatgtaattattcctttactagtatctgatccatttttaagaaatttaacttcccctgccagaattcaagaaaaactgctttccccagtgtggaactgcacgagactcaagcgtcacctcgagctgctaagttattaatttggaacacaggcttttaaacaatatctgtatgtgcgcccatgtatgtgtgggcagagggggcgatgggagaccagccaaatctgctgattaaaatgggaacaccgtggtgatggcggggctctctcaaaacactttaaaaggccgaagtccatcttgtggacatgctcataagatttctcttggagacaatggtaattcattctcttaaaaaggattggttcaaccctttgagtaggctacccacagcaagatgtgagatcagaaccaaaaaatattcaaagcatattccatgttttgtcttttggaaataatatgtgacagaggtggtcttgaatagtaatgatatatgtttccaaattaatgaaaataagttatttctttattctctagcagtgattcttgaaattcttcattctttttagaatatttgaagttgttatagcattcactctaggaattccaaaattatgacactaagtatgtatctcaaatcaggcctctgagtgggaaagggaaggaaacatatttttaattttaatagtctgcctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattctgtatctatgaaatggggatgattcctgtcacgctgttgctgtaaaaaacaaaatatagaaacacggaatgctgttcttggcatggagatttcaaactattgttcagtgaacacctactatgtgctgacatcccaatgctacttgaatcttcttattttcagcatttggtcagagctcatgtcccatttttaagatgatttgttctacaaaatcatagaatgtttgacttttaaagcttcttatagcccctcttgcccagtgatttttggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttgaaacagaagcttcaagtcttctccatccactgaaatgagttgttgaagtggaaaagtaagttctaattgaaccaccttctccgatgcagagaaaaagcagacttgaacaattgggttgatcttctatttctcaggttggagaagtgctttgaggaaagaaagatggggaatcaagatcagaggaatgcaaagttctggaatgtttgcctcagttgccctctactgggtctggcttggggaagtttgtagaactttttaatgagtcattgtaggttcaggagagatttcagatgtgggggacagggtgaaatgctttcttacacagaagtgaatgagttagtgaaactgtagcacgtacagtttgggagaatgggggcaatggggggattgtggtacgggagaaggagcaccagcctgggattcagacaggtctgagtttaaattccagctctggcacttgctaggtaggcagcgttggacaagttgggtaacctcagtttccaccttgagcaagtgcttgactaataacagctgtgactgttaccagtatggtaattacagtatcccaaggtgtaaagaagcagaagcatgattatatgagttgggtcaaagatttggctgtctccctgtccccccaccaatctggctacagggcagactttgctaaatagacacagatttacttccaatgaagtgggtttgctgcactgaataaagtagtttacttttccttcactgcagctgtgcttgaaattggacagaaagccaggtgtggtggctcacgcctgtaatcacagcactttgggaggctgaggcgggcggatcatgaggtcaggagattgagaccatcctggctaacatggtgaatccagcctgggcgacagagcatgactctgtctcaaaataaataaataataataaattggacagaaaataagatagagttgtagcaattagtctgcagtttttgactttattaaattcacttagacatgtggctgcaccattatgctaaggtacctgaggctctactatggtgtattcattgtcgaaaatgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttcagtgtctagaatagagtaacagtcctgctttatatttgtataacgcttagcaccagtgctaacaaaatgcaacatgagactgggcatggtgattcatgcctgtaatcccagcactttgggaggccgaggcgggtggattgcctgaggtcaggagttcaagaccagcctggccaacatggtgaaaccccatctctactaaaaatacaaaaaattgctcaggtgtggtggcgggtgcctgtaatcccagctactcaggaggctgacatgggagaatcgcttgaacccaggaggcggaggttgtagtgagctgagattggaccactgcacttcagcctgggcaataggagtgagactttgtctcaaaaaatatgcaacatgccgggtgcagtggctcacgcctgtagtcccagcactttgggatgctgaggtgggcagatcacgaggtcaggagatcgagaccatcctggccaacatggcgaaaccctgtctctactaacaatacaaaaattagctgggcatggtggtgggtgcctgtaatcccagctacacaggaggctgaggcaggagaattgcttgaacccaggaggcggaggttgcggtgagccgagatcacaccactgtactccagcctgggtgacagagcaagactctgtctcaaatatttcaaatatatatatatatatatatatatatatatgcaacatgaactactatgtaatttaaaaattttactagccacctttaaaaattaagaagaaacagatggaaatgattttaccatgtattttatttaatctaatatctcaaaaatctattattccaacatagaagcaatataaaaattgttaatgaaatattttacgtttgttttttccactccgagtctttggaatggcatgtgtgctttacactgacggtgcctctcacttcaggccggccctgtgtccagtgcggtctccataaaggactctggtgtccagaagttcccatggccgctccattccgtacttggttttcacaaaaactgtctcctaccttctaatgtcctcaattctacaggaaaatgagaatcatctccagacagtagaaactgtatccataatccatattatgaagagataaaatagccaattgtactttgtttttttttttgttgttgtttttcttgagacagaattttcctctgttgcccaggtcggagtgcagcagtgcgatctcggctcacagcaacccctgccttccagggtttaagcgatccttctgcctcagcctccctagtagctgggaccacaggcatgtgccaccatggccagctaattttttgtacttttagtaaagacagggtttcaccatgttggccaggctggtctcgaactcctggcctcaggtgatccgcctgcctcaacctcccaacgtgctgggattacaggcgtgagccactgtgcccggcccctattgtacttctgtttgaacttatattggcaaatgtagtaattttctagagttttagaggaggtagtgtttattattataaatatttgctgagaactttctgagcaaagggtactatttattctatataaatatgtactgagcatctgctagttatttaacagacttctaggcacaaaggatccaatggaaaaaataagaatattcatatttaacagcttctttgtgctctaggcattgattattctctgcattgatagaatttacacttgcagctttcaccaaagaaaatgttccacagtttaggcagcatggcaaaaatccatctctacaaaaaaataccaaaattagcaggtggtgcatgcctgtagtcccagctactcaagaggctgaggtgggaggatcgcttaagcccaaaagatcgaggctgcagtgagctgtgattgtgccactgtgctctagcctaggtgacagagccagaccctgtctttaaaaaaaaaaaaagaaaaaatgctataattttacaaaacctgctctccatgtatccctctctactctccttaagatgaacactgggtctggggtgcaggggtgccacagctggagttgaagaggaagttaggagaaggctaggaaccatcacggagatttttcaccctggttccttcattattacttgttggggatcagtgaagattagaaattgatgatggcggccaggcgcggtcgctcacgtctgtaatcccagcacctttgggaggctgaggcgggcggatcacaaggtcaggagttcaagaacagcctagccaatatggtgaaaccccgtctctactaaaaatacaaaaaaaattagccgggcatagtggcgggtgcctgtaatcccagctacacaggaggctgaggcaggaggatcgcttgaacccagaaggcggaggttgcagtgagctaagattgcgccactgcactccagcctgggtgacagagcaagactctgtctcaaaaaaaaaaaaaaaaaaaaagaggaagaaattgaacatggctttacagaggagcttctcttccctgcaggtagcggccttagacccttgtctaaggcaaaagtgggatttagggaaagatactgtggtagctgacacagaattgcaaaaggctgaaaacccccgccagcgaagggcagcagctgctcccctcctgtgggcactctattgccctcatagagagaaggcatctcccagcactttctacaaccacacccccaacccccaacccccaacccccagcttagttctctagaagagcagaccctcaccctcccccacctcctcagcccagcctggaaaggcccacggaaggactctgccagccctggctaaagttatgtgtccacctctagagcagccacctggcctggggacgaagcagtatgagcccacattctgagttgtaaaaccccacaattaggaaatagacttaaagtgctcccatcacattaggatgcaatgtgcatttttgtttgtagaagcttgttctccatttcttcttatttgggcaaaataagctcagtttgactaactctgccatctctaacccagaccccaccatgctctgacactttgacaagcacactggatgggcaaaagagtcaactaccgaaggaagacaattttcgtttggtctaaaactttatacctgtgatattctgtgccatggagagactcgtgcttaataattcactttccaatgatcttaggcaatgtagaagattacaaatactgtgagacctgaactcctccttcagggaacttaacagttttcagtggcgggggaaataagagtagattcctgaaaccatagcagcatccgatagaacagaacatttcctcgactctagcaaatctcttaattccaggtgtactcgggaagatagtagcatttattgggtatatactatgaagagagaagtgtcatatcctgagagggggtttataggcagtaaacattgtagtctttgccttcaaggtgtttgaaacataaaacatgctcacattagctaaatatgcctgcttcaatgcctgtacttatatcacacaaccgacgttatcaacctggtttcaaacgccatgagcaaaaatcaaatcaggtaatgtgtgtgaaagttcattatgactgtaccaccatacaaaccgagatggtattactccagtcagaccttctgttttatagtgtgttccagaagctggcctggttgcagaagagagtgagctcattagccctgttcaaaaaaaaaaataaatggaataataaagaaacttcaaaaccaaatgaaataccattccatgcacatcttggaaaagtttataacgtatttaaacatgaagagctattgtaagcttgacaataaaactgtgaggatattgttcatttccgagattcacttttccaagatagctctatcgtgaaagtctcttttggagtttatgtatagttctttaaattggcacagttggcttaaagctaaaacactgtagtttgcattaaaaaagaaaaaaaaaaagcaagtgcttttgcacaaaaggctgtaagaaatgagggctgcatatgaagcgagtgttccgttgactgtgtgagtgtgagatccttttggctttagtcatttatttggggcaagctccgaccttgatgacagatgatttcgtcaagctctccacaaaaggtacatgtctattttcatcgtcaactaacttctgtggagcacttgctgcttttggtcccctaaccatgaggttttattgacccatttgccatctctggggtaagtggatggaatcatctttcttgagaggagaactccaggaataatattacacttgtctctgagccatttgagcttgctatttttacagatttcagccttagttccttttcctcttcctctgtcaccctcagaacactgggacaagggggagccatgctgtttcataaacttcccatagaggttctgagtctcctttttagctgattcccatgagtttgtaatattttgatctgagctggttgcagtttgaaataaataaaagcaatctgatttcattctagccaacatctgatgggtttgatatggatgaaagctaatgagaggtacaagtgagacagtacaggtgaaaactacaaaatctctcttgtaaaatacacatatacgcagacccatattttccaatgacacttaaaaggagtgataccaagaggaaacactgagtcccatgaaacatttcttcaatcaggacagaaccatgagcagaggacatagtgggtggggttcgtggaaaaatagaatatatatctaattttctgtttgatgatggtctacggattgatttaattatgattactacagtaacttgcctagtacttcctgttcacggttgccttttacatgcacagcaggttgcttggggagctgatgtctgctcctagcctttctgctccggtaccctttgttctgttccattatgtttcagataatttaatcaaagttgtgtttgcttgtgcgctcccccctttgaatcattctcactgcacttctgccccttccatgcagatgcaggctgatgccggatgggtctccactggcctcttctctggacttctctggggcccgtatcagaacccaaaacctagcctcagcttgacttcttcctcttaccacggggtgaccccggtgtgatctcccctcccaggttccatccagcatgaccgccgggtctccctctgccctacttgattgcactcaccttttgttaccagtccaggcagcaggctccatgtctgggttgggggtgtttcctggcctgacggggcaccttgttcgtttcacccaggcaggaaatcacgtcttgtttcaacatcctgaatcttgtcctgacgtggaaaccgtgatgctagctgacctgacctgcagcctcaggcatccctcggccctttcatggcctggtgtttatgtggtccgtcctcacaaactcttaggatgggatttattgtctccattttcttttctttctttctttcttctttccttttgttattttttttttttttttgagtcttgctctgttgcccctggatggagtgcaatggcaccatcttggctcactgcaacctctgcctcctgggttgaagcggttctcctgcctcactcagcctcccgagtagctgggactacagatgtgtaccaccatgcttggctaatttttttatatttttagtagagacaaggttttaccatattagccaggctggtctcgaattcctgacctcaagtgattctcccaccttggcctcccaaaatgctgggattacagatatgagccaccgtgcctggcctacagtctccattttctataggaaatgaaagcttagtgagagaaggtgcccagacccccaatggctgcgaatcggcagagttgggccccagtgggtctcctcactccatcccccttgtaccacccagtgtctcaccagccattctgctcagatgggatgtagggcctatatagcaaatagaagttttctgggaaccccttaatgacaaaaaatacttgctttccagagtattcatggcaggccttgataatcttgagcctcaagtgcccacaattccttctgggactgactttaaacctttatttcaaatacaagctgggtcttcattattctttgttgcaatggatctctttacacgttaccctcagaaccacaaattagcaagagtctagctggaatctctcctgtgatggaaatttcattccctaagaaatagagcaacctttcttaattaggcatttactctaatgattcagaaagttggttctttatttttgctttattttcattagaaactaaagatttggatggtgttttcataatctattgagaactgcaccaagactgtcagtattcaatacatatgattaataatcagagggaagacacttatattttctgtcatacacacatacctaaatgtttaggccaagggcacatttttaattgattcaaatagcaaatataaattgtgcctctctgttacctgaatgtcttacttttttggaggttttgttgtcaggaactgccatataagaggcatgcatcattttaattgaatcttaaacctgacacttttattgaccaaaaaaaaggatttcaagttatttttcatgcataaagcctgcatgaagcctgtacttctttagtgaaggctatctcagatatgtatgaccttacctccttgcctttaggaaaaattaaacctcactgtctgagatccttgagatttggcaaatgttgatcaattaactcttcaaagacttatgatgaaataactgtaggcaataaaacatactgaaatatgtccaaatgaccagcacagcaaaatatgcatgaccctgtgcctaaggtctgtggcatacaagccttgggttctgtttatggggatgtcaccttctatgactcaggtccctgtctagaaacatgatatggccacgtcttggtggttccttatttatgcggtcgagtcttttgtattcttaagtcatctctggaggataaaagtcagagctcaaagtctatatatactgtcacaaaacaaggatgcagatataatgatgataaaattgaacctatgatttaagaaatgcgatatgaatatgatatgacaactctacctgccaccagtggactaatttcccttgttgccaggggagacctcatcctcatcctaatttacacagtgttgtatgtttgtcaagaatgcataattctgccagtctgttgtatttctaattttagcctgtatacatagaaacactttaaaacatttgcaggctactgcaatcatcgtcatacaatctgtatagttgttacatagaaataatatcagttggtttccccataataattttttctagagagctagctgttcaatgctaattcatatcctttcttaaggtatatggcaagtaaaatggatttcctcggggcctggaaggaattcctgttcaatgattggaacatttaaaagatttcctcttgatttcctacaaggaaggaataggaaagggaggtgattggtcttgttagcctggaaatagtattcactgggtcgctagagggtgggcagagagggacgcaaaaaggcgtgtgtcagagttcctgtctccggggaggtcacaggatcgttagacagataagagagacgcctgtgtctaggtgtctttggttcagtcctaatgttctgcttggtgtctggttcccacaggtcatttggggggtctgaatggtgatggatacctctcagagaaaaaaaagatttaggcttccaggcaaagtggagaatgaagagtaaagacttggaatgatgggtggcaggataaaatagaagaatcattagttattagaattattagggtaaaaagccgtgttaagtgctttgtaggtaggaggaccgtatatcccaatttgcttaggccagtcctggtttatggcaattgccctgacttgagttttagtaacattcccttttattctcaatagcgtcccagtttgggcaataagtcatatggtcaacatatatattgatgaagaattaggatcttaatataggaacagattgcgagtgaagataaaggtaaaatcaattttgaagtccccttatactacaccgtaatttgatatctatatcaatctctaattttacttgaggagtagtgttgacctcatgtcttagaagaaaaaaatgaaggtaaaaaaataataaaattttgcttaggccgttgtgaaatttcctttcaaagacggaactagaatttagaactcaaaaacctcatttcctatactaacccccaccctacattgccggggaaaatggaaaaagcaaaagaaataatgggatataaaaatgtatgggacacattctttcctctattatgagcttgtctcttaattaccaccatttatactggacatgtgatttgggtttccagaatagtaaaaacacagatattataagccctgtgatcatttgcaaagaaatctcatttgcccaggctattacatttctgttctgccttcagtggaaatacacatagaatggaatagaaatatgcattactatgagtaattccagacaccttaatgcttttagcgggagtgcatttggagtttgtttcctgagacccctctggtggaggtggttgttattcatgcttgctggaacagtcctccccacgtctgtgagctcaagcaggtcctggcctcagaaccacagaactccaatagccagagactaaaagaaaagggaaaaatggtttgctcggatccctgggttgcttggcccacaccctgagtgtaatatgtgatcagggttagaaagcaagtggtgggagcaggtcttgcttctgtgggcatggcctcctagagaaatagtccagcgctggaggcacagagaggggaggacaggcattccaaggctcttgaagaactgaaatctggaatcgacatgaagctacatcccgaagcagggaagtaacgacgggcctggaagggattcctgttcaattagtggaatatttacagaagtgttgttttgaagatgaatttatggatgatgttcatgtaaagtgagatagaatgaggggacagacagggatagggaagcaattaatttgccatagatgtgggtctgaaaataatctttactggcttgcctggtgttgtctaaagtagcaggggaagctttgagaatcctattgatttcaggttactatccaggaactataaaatattaaagcagaaaggagacttagtgatcattaaattcattctgaaatgagaaaaatcaagcccacagaaatggagggtttacttaatggagggtgtacatggtattaggggcaggaaccaggtctagaacacacccactggctccttgtcattaaccccgttgccctggagagaagagaagccggtggtcacactttgacagacacagtgtgggtgatgccagagccaaaaccttgggaagggaactgtgtggcttcatggacatgaccagatccacagtcatccactgggttactgtcttcccagttctcatcagccagggttgtttagaaacattgaaaaatgttgctaactgtggatagctctgtaagtagggttttccatctttctaacacttattacatttttttattcctggaacaattttgaatgagaagtggaaaccatggttttagccctacttatctcttaaggaagaatagattggaacagtacaggtgttttgcttaagtttgtggatttacttaaatattccctatgaaagctccggtgtacacatttattttattcatgatttcaacaaagctttactgtgcaccacatacagtccagcatggtcccatagagctttcagcaatggtggaattgtgttgcatccgcactggccagcgttgcagccactagccacatgttgctgtcgcagtcttaaaatgtggctggtgatcagggacgatgagcttttctcatatatctgttggctgcataaatgtcttcttttgcgaagtgtctgttcatatccgtcacccactttttgattggcttatttgttattagagaaatgcaagtgaaaaccacaaggagatactatctcacgccagttagaatggcgatcattaaaaagtcaggacacaacagatgctggagaggatgtggagaaataggaacgctttcacactgttggggggagtgtaaattagtttaatcatggaagacagtgtggtgattcctcaagggcctagaaccagaaataccatttgacccagcaatcccattactgggtatatacccaaaggattataaatcattctataaggacacttgcacacatatgtttcttgcagcactatttacaataacaaagacttggaaccaacccaaatgcccatcaatgatagactgaataaagaaaatgtggcacatatacaccatggaatactatgcagccataaaaaagaatgagttcatgtcctttgcagagaaatggatgaagctggaaaccatcattctcagcaaactaacacaggaacagaaaaccaaacactgcatgttctcactcacaagcgggagttgaacaatgagaacacatggacgacacagggaggggaacatcacacactggggcctgtcgggcggtggaggggaaggggagggagaccattaggacaaatacctaatgcatgcagggcttaaaacctagatgatgggttgataggtgcagcaaaccaccatggcacatgtatacctatgtaacaaacctgcacgttgtgcacatgtatcccagaacttaaagtaaaaatttttaaacatgtggctggtgactgagagatgcaattcttaactgtagttagttctaattaattgaaattgagatcaccacagatggcagaggctttcatgtcagtttcagactctggtattgggtcgagggagaaaagaaaaaagacaagtcatgatctctgaggacaaggtattcacagccgagagtggcagggatgaggagagacaggtaaacaattgtcacactggagtgtggccagttatgtcactgtgggaataaggtcctgtgagagcacggaaaagatgagcgtgatatgattcctctttggggcgggcaagcatcagggcagtttgacaaagagcagatgttcctgtctttacgaacggactgagaccgctccagacatctgagatgaacatgaagagaaaggaattttcaacaatggagcaaacatacattctcagcagtgtaaagagcagagcgccagaggcaaccgtgtacttctggtgtacttctgcgtgcacgttggtgtacacaccctctggggaggtgaactagcaggcagcttggcaagaagtcgcctgcggtgttctgcgtctcagcccttgttcaccatagtgctctgtgtgaagttggacaaatgcatctacctttctggacttcagtctcctctccactccccgaaggcagggcagagcagctgtatgactccttctcagatctgggcttagtccttacaagcttctgttgcattctccagctcctgcagtggccttccctcaagacaatgagaagcttcttggcctcctctttaacactgggtgctatttaatgagggcacctcaagatcctcccagttaccacgattgctggtggcagtcatctcccctccgacaacagttttgtgctctgagtgcctgtgctgtttccacatttttttctccccctcaggtattttagaccccaaagatacatgggtactctagggatactgtgtaaagactgggtagtatttggaactggcagccagagagacgacattggcaattcattcatctatcattacctcaattggcagtgttctcagtacgcagggactgtctctgtgtggctttttgtgagagggatgtaagatttatttttctctatgacctacctgctggcatggtacaaaaggtctctgccgaggtctgagggacctcacttgagctgcactaatagacggggggataactggtagaccaggagagtgtagacaggaagaaagaactcacctttgtaaatgagccactcaggcttttgattttgtggcccttgaattcccacttcagctgatggtcacactcatctgtggggaagctaattttacaagaaatggaacaggagggggttgctgttggatcaagaagatgcagctttggaaggtatccacgagggaatagccatcaatttgccacgtgtgtgagctctaccatcccgcagcacatgggagcgtgctgtgctgtgcctgtgtgctctcaaggtagacgaggtgtcactatatggtcatccacacagcaggtgtggccaaatatagagatctcgtgaaaaactaatagcctgccaaagaatacagccactttttcagggtcgtaaaaacactctgtgactttcccaaaatacagttactatacatgcactagcaaatcccaggatgttctcttcttatggtgcacatagctaaatacccacctgtggaatgtgggtttatttgggaagaagctaatcctattaggagtttcatattctcaccaatttgggtgatggggtctgtgaccaaagatcatagaaagtaagaaatacaggactcaaaaatgtgttcttcattatgtcttcacctcgtgctttttaaacttttttttttttttttgagacagagtctcactctgtcactcaggctggagtgcagtggtgcaatcccagctcactgcaacctccgtctcctgggttcaagtgattctcctgcctcagcttcctgagtagctgggattacaggcacatgccaccacgcccggctaatttgtgtatttttagtagggacagggtttcaccatgttggccaggctggtctcaaactcctggcctcaggtgatccacccgcctcagcctcccaaagtgctgggattacaagcgtgagccaccacacccggccatggttttcaaactttaatgtgcatggaaattactggaagtgtttgttaaagtacagatgctgcttcagctggttgggcataggtcctgagatcccgcgtctctcacgggctcccaggccatgcagttgatgttggtccatggatgaccctctgggtagcaacgtttggggtctttgtgtgtccacacatggtgtgtctgtccattaggaggaaagtgccagcgcatttgccaaagcgtttagataggagcctgttagagtttgaagttccaggaccaaggaaatctggtaaataaaggacagttgtttgttcatggatctaggtttataaagtgtgtatacattttgagattctgtctcccccctccaaccttaaaattagcaaaatgtagtctttctttgtcgagctctaggaataatttttctgcgtcagatgcatttttgggaaggtgcgtttggccatttcccactcaccgtgcccgcccagtatccctgcagtactttggaagcaccataattgggaaagagtagaaagttcttgccttggaaatgagattcttatctgggtcttgggcactggaggatctcaggcgcgggaggctcgcgatgggtccggggaacagctgctgtgttcctgtaggaggaaatgcctgtgatggaggcttctaaagccagctcccgtctcagagaagacagctctatgcctccacgtcgtgatagcaaatgttcccttttggctgttttaatagttctgcttcaagcgtatttgtttttccttatttcctagcatctttgagaaagatctgttctatactctgtagcccagtttggagagatatgacatgtttgactatgtgaggaaatatacatatttctcagggcttttttttttaaattgagtgttattggactttgatgtttgatttccaggcagtctttaatgtgaaaggcaaacacattcattttctatcagttcctgaaaatgttcccaattttagaagctctagactggtcttgccaatatagcaacatagtgacagttactcgtctgtaattctgtacttaaatcgtgaactgctagcactatcgattaatgctttatacagtttcaaagctgtactcccaggctgcatttagatggtttaaagcattgatttctctctctgacaactcttaagttattggctgccaaaaaaatgaggaaaggttggttaatctccatggctcatatgttgcttgctgtagagaatattggtgaagcatagtttttcttcattgtaagatgcactagggatgtgaagactgttttgaatcattgtgaaaactggaatcagaaaaacaatctcctcattcaattcaagaattcgagatccaaaacaacattcagtttggtatttggcagtttaaccaatatctgactttatgtaattttaattattggggtcagccattggtattgcattataatttgtaatgatttatatcagccttttaaaaatgctcacagtcatggacaaaactggaaaaaatgaggaagtaacccaatccaaattacttaatatcatctgctgtaattagaaattagattttagtagactgtttccataatacatttcagaattatttttataacttaatagtataaatacaaaataatttcagctttgttattttattatgtgctgtgctagtttaaattattccggttataggtgtatcatcaacaccttatcttcagcaaggattttaaatatgggctgaccaaatttatgtggaatttgcattttgttattcgtttaaaaacatacagaaaatggaaaaaaaaaaaaaaacctttgcaaagattctcttttgagtgctagcttttcctgatccctaaggatgccggctgctctgccaggaatgtgcccttcatattatatcttctagaatgaatgtttggaagggaaagcagtaagatgcaaaagcaagaaggacagatgatgttcatactcacagtaatagctgtctcccctcttatcagttgtgatgctggaacaaacacctctttcctgactgcagggtttggaggtccccaagtccaccctcacttctgccatcaatggcaagcggcactggctgcgtggaaaagccaagatgcctttcaccataccatgtctggagtctagttgctgctcaataaaccctggtggcgatcactctcgagattcagtaacattatccagaatttaaaaaaaatacaagcctgggcacagtggctcacgcctgtaatcccagcactttgggaggccgcggtggcagatcacttgaggtcagaagttcgagatcagtctggctaacatagtgaaaccccatctctactaaaaatacaaaaaatagccaggcatggtggcacgcacctgtagtcccagctactcaggaggctgaggtgggcgaatcgcttgaagctggtaggcagaggttacagtgagccaagattgtaccactgcactcagacctgagcaacagaggaagactctgtctcaaaagaaaaggaacagaaaaaaaaaatacaacaatgtgtggtccttgtattcaagccaagcttatttctgcctcaaagcattgtgccaagtttgtatgttacttcaggtttcataagccagcagatcctcttcctgggactgaaatgatgatttcagttttttcaatgcttaagcgtggaaaacaggcaggtaatttgtgacccataagggaggggtgagaaccacatgaagatgaaggtggtggaaaggagcagctgatgtcacgcactgtctacttaacattgccacgttaatgttaatgccggttatagaaagcaatgggtaattgccatatttttgttacggcttattgcagtgaatgcaggatgcttctcacatctcttacacatcaagtaagagtatttcttaaaaaacaaaacaaaacaaaacaaaacaaactctcaatgccacatatacctgaattgtgagtacttatttcacctaacaaatacctaacaaatattgatattttgccacttatgggttgtataaatgaccattaatatgatttgtcaggcacagtacacacaactaacctataaacaatgtgcagacgtaggtcataaactgtgacactcgaaatccaagtagtgcccctggtgggagatgtttcacatgttaataagcaattaccgtagtagattaagagtacagaatcaatccaagaagccaataatttagagttggatactgtagcacaagattgcaggaacctgagtgctgtgtgccacgctgcacatcagaggttgcaagatgtcctgcaatgcaggctcaggaaagtgactgatgcgctgtgttctaatgtggaattctacaggtattcgtggaaaaacatcaatacattagcaaaacctggaccgtttctggtgttgctggtgctgcatgggatgagtctgtggggcactccatgggatatatttaaagaggtgttattttgtctcaagcggctagggcggagatagagcatgctatttgccacattgcattctaggggttgcaagacatcctgaaatgtgggctccatgaaagcggttcatgctgtgatctgtacccccagatctcttcccaggcaggtctcatccaccaccagaaatggtccatgttttactactgtattgatgtttttccacaaatacctgtagaaatccatattagaacacagggcgtcagtcactttcctgagcctgcattccaggacatcttgcagcctctgaaatgcagcgtggcacacagcactcaggttcctgcaatcagcatgcccacatggtcataatacagacttagcaacctggaaggaagtctcagtgatctgtgacccagccctttctcctgatagaccgtggaactgcaggcagaagatgcacggcgtctcatctcagatacacagtggtggtgccgggatggtatgtgctctccattctccctggagggctcttggtccatcttgcttcagtgactagcatgagaggagtggtgatagcagcaggtgccgtggccactgggcaggcggggtatggagaacgcagccacacggccgccactcctgctatggaggcaccaggtcccgcaacactggtaccataggacagggcttcctggtatcacaggatttgccagagctggaacgtaacgcccacttcacaccttggagtatgattcaaagtagagtttgtagtgaattccaaaaggcatgtgattcaagctaactgccaagaccattcagagttgtggggagaaaaccccactgtgggcacgtgagtcagggaagcagcatggaagcggcttgggtaggattgtggcaactggaagggagttgggcgggccatggttacagatgcgggaagtggtcggagtggggaagaggacctgtctgattcccaggaagtgggcaggctccatgcagagcaggatcccccgtggagcctacacagccttgcacacctgaactgaggggcaacgaagaaggggtctttgtagttcccttggttaggcaagtcaccagctggaagtggcagccgagacccggcagggacaaccctgtctttcccagtgagcatctgatgatattatccggggcccgagcagctagggtagaaaaggagaagcatttaaacatcagtgcctcaaatctcctttccaaacatcccaggtatagaaagttacatcactcttgcaatttggttcatcaattgtcctcactgcaaagttgaacctaaactaactcctgttgggaggcagactagggacaagtgactttcagtgatgctgaactgtgaggctgaggcactggccatactgcctcccaaatggaaccctcgtttgtgcaaatgcccccggccagggtggtacccacacacatctgcacatgactttctcagtctcctcctaaattatccctattctttttgaaaacataaaattaacccaggtggaagtttgtgttgtaaaacatggagtagttttcaatattgtaataggctcttcaagaagagcagcatttgcccacaatctgaatttttagaaaacgtctaaaatctcgagttatcagcaggacgatatccacacagtagatacatccctaccggactcagtggcaaattatgacacaggccaaggtctatccttgcaccatctgtcatttctgagtcttcaaagagctcagagatgtcctctgtgtgcctccttacccaggcaggcagcctaaactcccagggttcttcccaggcagatctcagccatcctgggctcaggaaggcattccaggaaaccagaacgcaagggataaaagatggaggaagtcacctcttttagcagagtttgcactttgatgagaatgaaggctcacgcccagggagaaggtggataagagagacgtttaagcaccagctctaaggtagttgcagtttgctgggctgatttgggtgctcctgaaggatttgttgtctggggactcttgcctggtgcccaaggctgtaccttcttgcgcgtaagcctgttcagctctcggcccgtgtggcatgcaggccacaggagaaggtgactccagcccctcctccgttgactgcatttctcactgagcgtatatctgtcttgccttctcgcagattgttttcacgtggcatttcacttaactttagtctggattcacattttttttttccagaaggtgagattcttcttcaccaagatgtcacagtttgggcaaagttcaaagttgcttaaatttcttcgaagggctccatgagcagttgtactccagcaggactgtcactccaaattggactctccagctggtcaggggcggctttccaagaatcttgatgtcccagagcccctctgatacagtatctgaaaggccttttttgaatgtttggaatgctcttgtctgagagatatcttaatatgaaagcaaatacctgaagcataataaaagcttgtaaagcatcaagaaaagaaacgatctcaggaaaacctaatagtaactcgtgatccagggacatataaaactggagatacaccgtgaaataaaaaatgtcaggtacttaacagcatgcaaatgactgaagccaaaagaaaaagaaagaaaagaagaagaaccaattaactatgagagtctgcatccttccccagggccagtgttaatttccatcgctgtctttaagcacatcgttttgaaagagtgtgctcgggttcatccatcttatttcttctgttagcctcagaaagggagaaagtaattttcctacattgtcagcttctttacaaatgtctgggccttttctaaacagaacccccattgaatagaggaaaacaaccattctcacactgaatgccctctttaaccctaaatgcttattcagtcatttagcacctctcttcctcgccttttttcccttctgaacatgacctgaaagaagatgttggaacccccctgcatggcggcgggtggcattgccctgccccattcatctgcgcgttcatccgtttctcttacggagcagcctcaatgctctaccgatgtgcgggtgccaatctgtctccccgaggttattcagcatctaacgttgctatttaatctccagatttctaaacttgcagcagactggctgtgaacaggccagattatttgtttcctcttaaaataagtgcttgatggttgggttgtgtggggccggtccttggtggtcactgcatgtaatcaacattcatagactgtaggaaaatgtggtttaatgaaacattctgccactttttcttctttggcacgcgttaagcagtgcgtgcaatgcattgcaaatgcaagtaattcagagtttacaaggaaaggaaggagagtgaggaaccccagaggacagggacgtggggtggtgggacagggcttcaggctgatttatctttcatacagtagtttggccagtgggaacgcggagtgggaggaggctgtggctgcctgctcttcccaatggggaggaggctttacggtcctctcagcggagctggtgtttactaaaaggtctttcctaaagagcccaccgaatagaaaacgtctacttcccgtaggctcctgagaagcttcctgaagtcagtgagcacgttctgcataaaagctcatttgaactctgcactaatttgcctagcaattcataggaatcaatcatctaatattcagtccccatctaatgaatggctgcttaaacacactagtttttttttttcattgcattgggttaggaagtttgcagctggtaaattaaaataggaagcagtctttggtatgaaagtggcatattttaagtgccttggaatgcacttgttacaagtgctctgctgttatgtgagcagtagtttaatgtggttggctgggcgtagtggctcacgcctgtaatcccagcactttgggagcctgagatgggcggatcacgaggtcaggagttcaaaaccagcctggccaacatggagaaaccccgtctctactaaaaatacaaaaattagctgggcatgggtgcacacgcctgtaattccagctactcgggaggctgaggcaagagaattgcttgaacctaggaggcagagtttgcagtgagccaagattgcgccactgcactccagcctgggtgacagagcaagactccacctcgcaaagaaaaaaaaaattaatgtggttgaccattagaaacacaacatcaaaattgttttggagccatcttagttggttaagattgatgtgcaaaaatcaaatatttggcagttataaaaggacataccatagattttaactaatctcttttatgtagagagtggcaaaaaatcttaatgctttaatgaaacctactttacaatcacgaatgttatttgtattctgtgaacatattgcaatgtacaagcagctgaacaatgaaataaatccaaaatccccaaacacttcccagtcagctcagcctcacaggtgtccattgggtccttggttctttgcttcctctccatccccagctttcagcacattgctgtgtggccgtcttgaaggaaagcccttcattctcttcaccttcgctcaggtttcctggctcactggctatggtgaataatttatccctctgattttaatgagtgtattttattgtgtttttaaaaagtagggacccaaactgatcttcatgctatctctttgtttaaaactatatttgaaaaaaatacttccattaattttttagatattgaatccagaagcactggtgatagcagcaataactaacatgtgtttttcatgaataggtggcaattattgcaaaaaaatgctttacatacgttattgcaattaatacagccaccaccttagtcgctgttattatacctaccttgccccagaacagtgaggcttgagcagctaaaaccacttgcttgaggtcttctaggcagggagtaccatgaaacccgtgtccactacagaatgcctggcgctgctctttttggctctgagtgtgcttacgattttttgaaaaacatttcccttgagacatccttttcttatagtatttgtagttttttcagcatatataaatatataaattgaattattataacataaacttataaattacattctctaatgaatggattcaaggctcctggcagagatactagtttttatgcttgtaatcaatcacacttaaatatcatgcaatccaaatgctaacaaaattactctgtccccatttggcatttagaaaacatcaaaaacatgctgatgatgccaaatagggtttttaagaatggggcgaaaggtgaaggtgtcaagtgcagcgaggattcctgcagctctttccttgtgtgggggtatgtcagcgtcagtgcaggctgcggtgtctggctctgtccttctgacatctgcggtggctgtggtccacctggagaggtggttatgtaggactcagggaaatacataattgtgagcattccatttattcaggttttagaaatgaaatctacaatcgcatgtgcctttctcatactctgtagtcgcagatctgatgagaaaagtgagagacagaacagagaaaaccctcactcctgggtcgggctttacttcttgactgtccaaaaaaggaaagatataagattttgattctttcttggaagctgcatcattactttgctttattgttcaagaaattgaataataggattatataataataatatgtaataataatcctattattcaatttcttgtcccttctgtttagtcttggggtgtgtatgcatgtgtgtacgtgtgtttgtgtttcacttttctccttgatgacatttaagactgcacccatttttatgttccaggtgttgtagatcttgtcaaaatggctgtctgttccttggttaccttctcctataatgacgcaagaagaatggttgaatttaaaaggcaatacatttagaaccaattaaagagaacatttttagcacagggtgtggcgcttacaagagttcataaaaaccgaagttgctgggaatgagttgccattcacctgcactagaaactatggacttgtgtcaacgatgggtcctttggggaggaaatcatctcatcacctgtgattcttttcttgttatcagagggagaaaatgttggcacagcttccctctagaaaaagatattgttaataattggttaattatgaagactgatgaagaaaagacattacagctgagatggttgggagggagagaatgtctaggctgtgaagcaaaaggaactaatgattagccagcagggtctgacaaccaggttacggtcagcagccccaggatatctgatcgtgtgggcacagcatggaaaggaatgcctctgaattggcctactaagctgaggcagaacaggcagacacactgggatttgagccggggatagggtgtggtcaggtggagagacagaactgaggccttcacatgtttgggggttctaggagggacagattctgtccagcctaccttttctcaatgcattaaactttggcaaagtaatcaggttgcagaagcaacattagagtatcctcctttagctgctgagttgggggtgaagtgggctgtaagccccggggcagttttcagaggacaggctttgagactgcctgaaagattcatcaccttaaggataaatttcctggaggcgaactagaagatcctgtgcattaacagaacagtcaatgcctgttatccaggaactgatgtgaacatctgacagcttctgtacctttcaatcttcaagcactgcatggtgaattttgtgatttaaggaaaccataaatgaattagatcacttttttccttccaaatgcgagattccaaatgacagcagaatttccgtccacttcctaaaagttaaaggtagaactgcttgagtgaggctaccagtgctgaactggcaagccaatcgtggccaaagctctcaaggtaaactgaaatgatcaatgtatttatagtaggataatcaaaatttatttattaaagaaaccaagatgagaccaagagcatccagtggccaatattgatgtgcctcacttgaaggcatttcaaaccatctcgccgctaaccaaggtacagcaagattgttcagctttgctgaaaatgacttgaccgtagatttgcttctggggcaaatggattgtaaattgctaaaatgacactggtttgaatggcctgaaaagaggaagggaactgctgcttccgtgttccctgagtgccttgtgtcattacctcatttactcactgcaacgccacacactttgtggcttcctgattttacagatgagaaaaccaagattctgaaggagtatgcagattccccaaaggcacacagctaatcagcggtggagcgaaattccaaacagctccaaagactgcctgtctccaaggggcatctcactgcatcttcgcaagtgcacaggcagcgtcagtccgggcactgaaactgacagctgctgcggtcttgattttgagacagtttgggtctcagccagtgctattcagcggcttgaagtccaaaatcacacccgtgcacatgtaggattgttgtctcacgtatcagtggacctgtcccctgcagggaagagttgataaatatggcactctgcttcacttttcttgtttttgttttagtttttgtttttgaaacagagtctttctctgtcaccctggctggagtgcaatggtgcgatctcggctcactgcaccctctgcctcctgggttcaggcgattctccggcctcagcctcctgagcaggtgggattacaggcgtgtgccaccatgcctagctaatttttgtattattagtacagatggggtttcaccatgttggccaggctggtatcgaaatcctgacctcaagtgatcctcccgccttggcctcccacagtgctgggattacaggcgtgtgccaccatgcctggctaatttttgtattattagtagagacggggtttcaccgtgttggccaggctggtatcgaaatcctgacctcaagtgatccgccagcctcagcctccgaaagtgctcggattataggcgtgagccaccgtgccccaccctctgcttcacttttctactctaagttcttttaaaagaaccatgacatggcagaagaagagactgatgaaaggtaggcaggaggggcactgccctgtctttggtcccaagccttttcctctcttatctgcagtcattcctgttaaggttatttccttgggaaaattccacacccacaattgtctgttcccaagcacaccctcacgtctgtgttctaacacccgcttcttacctactttctctcaataacaataaggtaagaagtaaattttctaactggcagacaggcgtatgaaaaggtgctaaacatcattgctcatcagagaaatgcaaatcaaaactgcaatgaggtatcatctcaccccagctaaaatggcttatatccaaaagacaagcagtaacaaatgctggcgaggatgtggagaaaagggaaccctcatacgctgttggtgggaaggtaaattagcacagccactatggagagtagtatggaggttccttaacaaactgaaaattgagctaccagggaaaggttttaacaagagtactgctaccagctgtaccagcctgcgatacatgctaaggactcaggtgctacgtgagagagatccagttaaaaccccagcttcaagatttaggggctgtggaagcttgtacgagtttcttggcaactctgattcacattttccggtgagacccccatctctactaaaaatacaaaaaattagctgggcgtcttggtgcacacctgtagtcccaactactcgggaggctgaggcaggagaattgcttgaacccaggaggcggaggttgcagtgagctgagatcatgtcactgcactccagcctgggtgacagagtgaaactccatctcaacaaaaaataaaagatgaataataacctccaagtgctgttgtggggattaaatatgagaatatgtttaaatgcttaatagctggcacttaaacataagtggaaaaagtgatcatgtgaccgctcggcaaatatcgctggtaccgttagttggtttgggctgctataccaagataccatagactaggtggctcaaacaacagacatttatttcctgaagtttcctgaagttctagaggctgaaagtcgaggatgagggtgcgggcagctttggtgtctggtgagggctctcttcttggtctccacaccgggcaggaggggagagagagtggaaagaggctctcacctgtctcttctcgcaaaagcactaatcccatggtgagggcctcaccctcatgactcaccacttcccaaggtcttaccacctgataccatcccactagggtgacgatttcagcatggaattgagggggcacacattcattctatattttagattgtgctacttgcaaataatttcactgctggaaaattctgaggggctggtcaataggaagtgcatgtcattgcaattcttatttgcagtccattttcccatgggttggaaagtggggaggaaggcatcctactggtctgggaagatccatttgctgatacaggtaagcagatagaggtggatttcccaaggtggaaatcctaaggtggatttgcttagtcttgggacctgttgctgtccacgcccctaccttgggctttgctgttcctccttccgccccacattggctgagagcccagaggtcagctatgcttcccattctgtgtggactctgccatatgcatccataaaggccactgccagccacactctgcatccctcatttatggtccctggaactgggaccctgtctgtgctaccccttgcttccttctcctgatgtttccaactggagagggagaggacattctcattccagagcaagccctgctgctccctcgttccatccatcatttcttcgcatgcaaagtaccttctaaatgccaccagaaaactttctgtcagtcagacagacatgcttttgaactgaaacatactttgattagggagcaaggtgagccgattctttctgttacgtatcagcaaatggatcttcccagaggggtagaagccttcctccccactttccaatccttgagaaaatgggccgcaattaaaaagacaagcacttcctgtttaccagcccctctgaattttccaatggtgaaattatttgcgagtatatctcactctttctcagaggttggcccagactcccaggataaaggaaagaccatttgggtcttcacatactgggaggaaacaaaactgaagacttttcaagcctctcaaacctactttacagtgattctctctttcatctttctttttttttctttgagatggagtcttgctctgtctcccaggctggagtgcaatgaatggcgcaatctcggctcactgcaacctccacctcccaggttcaagcgattctcctgcctcagcctcccaagtatctgggattacaggcactcaccaccatgcccgtctaatttttgtatttttattagagacgaggtttcaccatgttggccaggctgctcttgaactcctgatctcaggtaatccacccacctcagcctcccaaagagctgggattacaggcgtgagccacagtgcccaggccctccttcacacttttaattgggaccccccctgtgtcttgagggactctgagtggcattacagtggagtcactttgccattaatcctatcactgagagcaccaagcaggtgttcatgcccaggtaggctgagcatctgtatcaaggcttcctgagctttcctgtgccttccatcgtcacttattttactgcaaaataacaaatgctttttggggatacactaaagctaccacacatttaatattgactctggagtttcaagtaacttaaaatctactaatctcagtgaactttcgcccagagtataatgttttccattttctatttttcctttcatgtagttctactctagagatggatgtgagaaagataatacaggaaccatcctgtatctcagcaaactctactgaaatcagtaggtatcatgtatgtgcatgcacgtacacacacacacgtgcacaaattagccctgtaatgttattccatgtcagattgttgcctttggccaaactcagcgattgtgaatgacatctcctgctcggttcatgtaacgtacaggagacctgttcttagcatttaccattatccttccagtcttgactaaggttgggtgcacattcacagagactaccaactctcgattcagggtttgaaaagtctgaatggttgtgtattaaatggaaaagatcagaccaatattccctagccttggatgaaactgtttgtttgcaaaatgatgttttagacagaagtgagttttcagaacattaaaagattccagtgataatatttgcaaatcctttcatctgcatgaaaatttagcaactaaatctggccattaaagcataatctttatttgaccaaagcatgatataaaaatggaataaactataatttatctttgctgacagctaattacctggaagtctgattaaagggaaaactaaatttacttaattagtgttttggtgtttaatctgtatacatataaatatgcctatctcctctcctacatgaacatttctagaaataaattaccatttttattttgtccctttcagatgctgccaaactgagggcagcattagaagaatgggtattttagcaacaatggtagcaggtgtttgtagactgtgatcccattagaggagcagagtgaggtaacacaagaatgggatgcttaccacaaagtagttttcttttttccccaatggctcctcctttaactgtgaacaagaagagtgccaacttgtggagtgaaccagccctgccaatgaatcctggcttggtggtggaaaaatctgcatataattaagccccttgaggcaagtggactttgatagacaagaggtggctttgaaaacgttgaaatcatttgttttttagcagcagtatttggcagtgttgccttttgacggtttgaggaactatgctgtaagtacagccaaaggcagaggaggttttatggaactctcagctcccacccccacctcctgatgctgcaaagttctcccactagatgcaatttaaacaggagacatatgtaacacacctcaggtggtgtaatgaaatcatcctcttttctgagcttctgaaagtcaaatatacttatattaattttttaaagtgatctgaaagtcatacgattctattcttgaaatagagaggttttcgttacttaagtggcagacttactgacagttcagttataggcttacaaataattggactaaaatatgatttttataaagcattgtaggttttaatcaaaatccctacagaaatgaaagtcttaattaaatctgaaatcctacttcccagacctgaagtttccaatatcattttttattctcgcccaacatcctctgtgattaaaatagaacataagtggtgaaatcgctgattatttaaaggatagcatcatagaaacaaacccaaagcacgtagaagtcattttagactcatgaaaggtagaagatgaaagaggcttgcacagcatcttcatctcaggaagacttttgggtcaggttctgttcatttcattatcgtcactcttctcggttgcataattggaagttctctaaaataactacttctgacaaaatttctaaaagttgctgagtggaggcttaaaaaaggactaatatccttaatgatttgataaagattaaaatcacagtttcaggaagggttactttttgcctacttcacagacattcaccctcttctctggtagcctggacagtcattttctagaaccatcttccttctttattctgccatttggctgaatgacccttaaggtgacacaaagtaaagggactatgacaaggttaacaaatgtgcaacacaagttgcctgttctctgttgtttcgatgaagcattcagctcaatataaaaaactatatctcattaatacaccttccaactgggcagaggatgggagcacagaggggtccacagctgtaagtggaggcaaacatatgccatgaaacccaggccagtgaggaagggggtgacatgtggattttaatagttaatttttgttgttgttgttgtttgttgttgttgttttgttttgttttttgagacggagtctcgctctgtcacccaggctggagtgcagtggtgtgatcttggctcactgcaacctccacttcccaggttcaagtgatgcttctgcctcagcctcccaagtagctgggattacaggcgcacgccaccacacctggctaatttttgtatctttagtagagatggggtttcaccatgtcggccaggcttgtctcgaactcctgacctcaggtgatccacctgccttggcctcccaaaatgctgggattacaggcatgagccaacacactcggccaatttcttttttgatgtccaggtacagagaagttgacattttcatttaaacacatacttgacccaaggacacaattcctttaatacggctgggtatgctaagctatggatcatcagtgccacagtaaaaatggacttgtgtttataggttgtctcctggagattgttgtgaattatatgcattttaggaaataataaacttgtaatatgttcgcctgtgtgacttaacgccgtgtcagctagagtaagtgtgcagcacatccaaaccggaccttctatggctttaatacttctgaagacctctgtaaagattcttccttctcagtacccaagtgctgaaaaaaaacatgtattattataggtcagaattagcattttagtcagttattctagaagtagagtaaaaaacaaattttcagactcacttatgtatttttcacatgggtaatcctttgagtcaggaaactggctagagttacattccataaataaaatgttttgatgatgatgccaacttgggcatggccttgtctcttaacttaggaggaggacaggcagacctggggggtgatgattaagtaaaatatcagtcagacagatgaaccgtaggacaaaaccaccaccaagggctgtggggatggagatgagaccctggtcacctcccctggagaatgtggagaagacttcaccctatggttgatggacatgtggtctggggctggaaggttcagtgggattttaggaaggggagaaggaagcaggaacaggggaaacagtttgatctgagacactggtgtaaggttgggataattttcagtgacatggggaggaacacggccttgaagggtgggagagtggtcttccattcatgacttactgagcctgtcatatgtgtgatgcagtggaatccacagaggattctgtcctggatcacacgcaaacccagccttcatggagcttgtgtgtggtatggcgtgctaagtcgtagacccattacttaaaatgactgtgttgttaaatgtcaaccgagtatcatggagacattcatgatgggggactactgtggtctagatcagcggtgtccactaaagacatttgaagacgggctgggggcctgtggtctgacccaggccaggaagatgtgtagttcagagtgagttgggtatcactgctctgccttgaacaggtgcaccctggtgttatgggactatcaggttcaactgcccgttgcatggtaacagaccaccagtacaccaaaacagcaggatgtggagcagacaatgtgtttaataatcatagggcagctgaacaaggagacaggaggaaacctcaaatccgcctctctgaggagctttacatgggtgtttttaagggaattttggttagggggcttaggagctggagatcactgactggacagtgtgtgggaaatgaaatcataaggatgtagaaattgcactcctgcgctgaggctgttcctcggagggcattttcagatgggctggagtcagtgggcccattggactgtaggttctggaaaatatctccaaatggaaaatttgaggtttcttaacatttaaggtgttacctagagaagttaggagcatgtgacgggggcacgtgacttctaagcagcaagcagctatcagaaagtgggccaaaggacaagctggttaatgcgtcactgtgcttctacttaaagcttatgcttttgttaaaaatttagcaatttggttttattaattttatgaggacggtttccctggtgagcatttggctccacagagagggatccaacagctaagagtctgcagtagaggcgggatcccacagcttcactgatcaccccattttcctgtggccccaccaccatctcttctcttctcccaggaccctagctcgggtggaaacagtggggaggccttggtctccagctcagaacccaggagccaaaaatagcagctgagtgtaaattttcattaagacaggggattagagatcaaaaggggtggcctcccactctccagaccccaactcctccctgagtcagcacccccacctgcacctgcacctggagggaccctgcctgcccacactcggtggtggccacagcctgcatctagcagggtgtaccctgtgccaggtggcaggagagcctggaatgtgctgtcagttctcagctgatctacaagggtaaccacagtcaaagccattttaaggaggggaaagttaagtaaggaagaggccaattaatgtgcccatgaggatgttaacaagcagccttggaattggagccaagacaggactccagagcctgcatggggggcctctgggtgtatcatctttgctccagctgagcaccggcttgtctcaagaacaggctactgcatggcacctctgctcccctggggtcctggaaaggttccctggtctggggcatctgctcccagccctctggaaggtgggagtgaggatgatgacatcccagcagggcactggccgaccagcctgctcctatagcaatgccttcctgtcctcctgcccactgcccctttgggcactgctggtggccagcactggcggccagtgctggcctcttctccctgctgcagagctgcttccataggcggacctggtcagagctcaagtggaggggaagcaaaccttttggagtgtcttgggttacctccttaaacattaaagacaaggccgggcacggtggctcacgcctgtaatcccagcactttgggaggccgaggtgggcagatcatgaggtcaggagatcgagaccatcctggctaacacagtgagacatcatctctactaaaaatacaaaaaattagccaggagtggtggtgggcgcctgtggtcccagctactcaggaggctgaggcaggagaatggccagaacccgggaggcggagcttgcagtgagccgagatcatgccactgcactccagcctgggcaacagagtgagactctgtctcaaaaaaaataaaaattaaaataaaaattaaagacaaattaaaaatttgtccttaaaaatgcagggacatggatgaagctggaagccatcattctcagcaaactaaaacaggaacagaaaaccaaagactacatgttctcactcataagtgaaagttgaacagtgagaacacatggacacagggaggggaacatcatacactggggcctattggggggtgtggggtaaggggagggagaacattaggacaagtacctcatgcatgtggggcttaaaacctagatgatgggttgacaggtgcagcaaaccaccgtggcatgtgtatacctatgtaacaaacctgcacgttcttcacatggatcccagaacttcagtaaatttttttttagatgcagatgtttatgcactgacttaaatatttaataaggcatgctttaatttgtttgtttttacttattgttttaaaagctagagtcctgaccaatttgcttctgcctccacacattttgtttttagagatataaactacaagtatatctcagcaatatgaggccaggaaagagatgctccgagcatgctctgtagccgtggcccctgggccagcagcatcagtgctacctgtaggcttcagacctgcagaatcctagggcccagcccagatgcactgaatcagacctgtattttaacaggtcccctgggtgacctgtaaccacattccactttgtgaagttctgtttaaagaagcaggcctgggatttgcttactattcagtgaaactttcaataaagcttcttttctcttcctccgtgaacggcagttattttctcgtagcaagagtctggactacagttgttctgaatcttttgagtagatattgaaggggagatacatgagcatgcaagcagacgtgcccagtatagcgagaaccagaataatgaacccctgcaaagtgggagggcatttggaaagagtgcacgctgagttcatccccagcataaaggaaccagcccgttattctaatctgatgagggaattcttcctgacaattgagtgatggaaggaggcattttaaatctttccatgtgtgtctcttctggcaagtggacagggcttgtgatgaatcctaggtctgataccagggtctttaatgtaaaagacaaaaacatactagacatctagcctattaaacttgaactccagccaaataagagctgatttcctgctgcaaatcaacaaaagacctcctgcacatggaagacgactctgacactaacactgatttagggccaggaagcctgcagtttaaattaagctggaggatactagctttatatgaaaatggcaggcaagtgtctgtggctcacagaacaagtatgatatacttttgttgcaagacctttgcatagaaaatcatcttcttttagaaaataaattccgttgccaagttttgtttcccattctactctgccccttaatgtccaaggagaattctccctgaagtccttgaggatggggcttattcagcacatcatagatttatgaagcctttgccatgtgtcaagcactgtgctaagcccaggggattaagagcaacaggcaagccacagtctccctctgtgcaccagccctggctccgtgaaatcaggaaagcaggaggaaagaactcaaagtgcacgcctggggaagtatcactgccacctaaacccttcttctcagctatcttccctatccaaccactagacacactggtgtttctagtcgtctcaacttgctctctttctatgagttccacaattctcagtctagtaataatagccaacatttcttgaatattgtcatgtgtcatgtgataagcccagtgtggtgttttatatgcattttaccatttaatacaatggccgtataggaggcactatctttaccctattttattgatgagatattagggactgggacagacactcctcatcctgagcctaagccactgcaacagcttgtaaactttcccttccaattccaagctactcctttccagtatatcctgcaaatggcttccctattaatattcctaaattatgatttcgctgggtgtcttttctcttcccaaagataaacactattttgacaccttcaccatccattcggtttggcttgctttggaaccctgtataaatagaatcatgcaatacatattcgtttgcatctagcttaatttgcctaagattatgtctgaaagtcgcctcacatgtagtactggttcactcttcgcatttctgtaaagtgttttgttttaggaatgtagcaccatttattccttctgctgttggtggatgttcatattgcttccagacttgatcattatgcacaatgctgcgggcactcttgtatgttcagtgcataagtgcatgcgtttatattgatggttgtgagctatgaacatgttcagctttggttgattctgccagagatttccagagtagttgcaccaatttatactcccatcagcagtgaaccagaatgtcattttctttacattctctcctcacctgcccttgggaggggtgaggctgttttggtggtggtggtgtttttaccattctggtaggatcccattgtcattttgatttccatttcttaggtgacttgagcacctttttagatgctattggccatttgggtagcctccttagtcaagtacctattcaagttttttgctcatttttaaattgtattttatttgctcattttgtattatgttgttattgtatggctcccttatacttgaactacaaaagttatttatatattctaggtatgagaccttcatcagatacattattgcaaatatcctttctctgtagttggccttttcatataatatttttcacaatggtgtcttttgatgaacagaattttacaattttgatgaagtctaatttgttaatctttgcttttttagagttttaatgaaatatctagtgttattcaagatcatgaaaatgtttctgttatttgctagaagctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccccaacccccccaccaaaaaaaaaattctaacttattatatcaatcttttcaatagtcagacaattctatctaagaagttaaatgtaactgaattccatgggcttctcaatcatttcaaaaattacaacttttaaaacaaaataataattccggaagtagatatacacattttcctgcaaatgtttctgtactatgtcacatcttgctgaaggtcattttagttaaattaatgtaaaatgcagactgcatgaaataaagaataaaaagaacaaaagaatagcaaatagaaagaattaaaaaaacatgggaaggcaattagcgaattttgttgaaatttgacactacttaattagcagctcaaatttcctgaagcttgaggctttaccatctagacaatattacattgaattttgggggtttaaaaatataattaaaagtttattggacaaaagttttacccacacctagcacatcatagacaacactattgataaaatgaaattaagctactgtatttgattatcctcataatatattttaaatgaaccatgaacaatgaatagctgacctatagtaaaagcaagaggttaaagtaaaaagaaatgtatctaaaatgaaaaaacatacacagtagttttctttgattttaaaccaaacatggatatgcctgtttcattaatgcattatctttagaaagtaatgtggggcttttttttttttttttgcaattgaaaataagattcatttaatcagctatcgtagttcatctgttaaattacagcactttgctgtccattttgtaaaataatcttcaaactaatgaagtaaggtcaattgcatgcaattttattctagccaaattgctgttaattgcatcaacggctttggtaaggtcaataaatgttgcctttttacatcctctcctgaaaatggcagaaaataaacaccttttctctgtaatgtattcaggctcgaggcaactcatagcaggtggactattcgattttcattacctgatttgaaaatgttccatttctaaagaattgtgggaggtattggagtcaccaaagcacttttagcaaagatatcttttagctgggcctggtggctcatgcctgtaatccaacactttgggaggctgaggtgggtggatcacctgaggtcaggagtttgagaccagcctggccaacatggtgaaaccccatatctactaaaaatacaaaaattagctgggcccgatggcacatgcctgtaatcccaactactcgggaggctgaggcaggagaatcacctgaacccgggaggcagaggttgcagtgagctgagattgcaccattgtactccagcctgggtgacaagacaatgtgaaacttcgtctcaaaaaaaaaaaaaagaaaagaaaagaaatctttctcggaagtgctcccttgttactcttgaattatgtcagtggtgtccctcaaatagagacaaacttatactgaacaactcagagtagattgtggaccttgacttgttaagattttaatttttatgataatcagtctagagcagatcatctgttctcctttaacctgtcttacaacaaacagtaaatgtttgtatgtcagctcaaccatagttatactgtgaggtataccagttggctcacctgctcagccgtgcagcctaggtcagtgtaaggaggggatatattacctggacccatggagggttaggacctcgctgtggccttattcctgctgcagacctgacccagtctttaggacttgatcacatctttacaagctttatgctttaagatatgcttttctaaccatctcaatttgtaaactgtgaacactctgtggtttctgaaatggcggagatgtgtctgaaaggtgtcatgtgcgccgtattacaaagaaaccctaaaaacagcaacaagtgagagatacaggtggaagtaagagcagtggctggaggcagagagagactgtggcaagcggatggcactcgacgtgtgggggcagttccctaggacctctgggagagttgcacttatcctattttccttgccttcacataaggtcacaatcactattagagtctgtttgatatactcattactaatattgattttacagttcaagaaacaatatttcttcttttgttttgagatgaagtctagctctgtcacccaggctggaatgcaatgacgtgatctcagctcactgcaacctctgcctcccaggttcaagcaattctcctgcctcagcctcccaagtggctgggattacaggcagccaccaccatgcccggctaatttttgggtttttagtagagatgaggtttccctatgctgaccaggctggtctcgaactcctgacctcaggtgatccacctgcctcggcctcccaaagtgctgggattacaggcgtgagacactgcgcctggccaagaaacaatattcttcttttaaaactgaatgagcagaaatactgttagtagccagctgaattcaggaaatgtgatgcatgtgctggtgcacatacccaagaagactgaagacagcatagaaggacagaacaaaaggccagtgccaagggtggcagagggagtccttggtgcactctgggacaagccccctgcgtgctgggtgtttcgggtggtctgtctccatgtgcaatatcagtcatgtgaagccttaacaaggcattcatttagttagtatttcagatttgccaaccctgttggtgttgggataagggttagagatacagagaagcacccctgccccggaggagatcactgcctggtgagaaaaccaggatgggcttctactcaccccttcaagtccttgatgaaaggttccttctgcaggagcccccagcccctgccttctgctgtgtcctgctcctcctcacctatgctcctggcccctcttcccctgccttattctttatggcaccattgcctttccagcttagtttcagtggcttgctcattttcatttctcctcactatcacacaagctcccagagagcaggaggtcttgtcattttttgttcatttgtttccaccaagatacttagaacaatgtctggcatggtgagccctcaaaagtatttatggagggaatgaatgaactcgtgaataaatgaatgtatgaagtactaatagatgggtgagcatggaactctatgtgatcaagtgtaaaaggcactttcccaaacacaggacttaatgagaggcagtcagatagtcaaacactacagcacttgagttagagaaacgttttgactaatcaaggaagcctttctgggaagtataaatgtctgcattagaactagaaagtctagaacgccgtaggaaggtacagaggacaagaacgatctccttgggcaggcagaaatgatcgagctgcgagctgccggaggaccgcatgcaggggaaattttgcttttctgagtgctgcttggctttgagatgtaagatttagacgttagacactttctagctcattttactatgccagtagtgatcctccctttcttatttctttaagaattgaagctggcatgaatctgttttcaagctgccatttagaagttggaatagtgtgttatattaactttatttattcttaaaatatcatcttggtgcccaggatgacactgcctgaggagctatcaaagagccaatccctgtgggatttgtgagaaaattcagccatctctagacctccaattccaaacctctttcatctcccaagactctatactttgatctaacctcttgagtgacttccttcaatttcttcctttcacagcaacaatttcagtcccagggcatacacttatacttataaactatttctggggccagcttgacctcaaacccgtacaagatgatcgttccagacagagaaattctcaggacatgaaaactttcttagaatgtgctgaaatagggttgtgaatgcgtgtgttgctacctctgaaaacttgatttagtgctgtccagcaaaagtcttgacatcctatgttagttggctcagctctatacaaagaatctgaaagcacggtagaagatggttggcttgtgttaggttagaaaggcgtaacaatgagttgttttctaagtgaccagcatgtgtgatttatgactgtattccagaaaaattcaattatatgagataaataagtacagagttagtatggggcttcagaataacaggaagcagcataaatattgccctcgcccaccagaattcatcactgatggcctgctctggccctgccttctgctgtgcatggaatttttattgagcttgatgagattctgtgtaataagatgctggattccgggggctaatggcctacgagaagatttgagtgttgagattctgtataatcagatgctgaactccatgggccagtggcctattgagaagatccgtataataagatgctggattctgtgggccagtggcctatgagaagatttcagcattgagattctgtatagtaaggtgctggattctgtgggccagtgggctatgagaagatttgagcgttgagattctgtataataagatgctggattccgtaggccagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaaaaaaaaaaaaaaaaaagaattggggtcatagggaccaacattgagacactgttgttgaagcagcaatgaataggtattttgtccaaataaaaggacgtaatttaatcattgttaatgtattgcccatcattggtaagccctcgggcatacacttacacttataaacttatttaatccacacatagcattatgaaggaggcattatcatccctgccttacagatggagaattggagtagaagaagtagtaggtaacttgcccaaagtcatagagggtatcgacttatcgactgcactgctgagtttagggtctgcagtttgtctgccatgatggctcacatctggagtgtcaggttcagccctagaagccacgttgtctggtggtgaacactgaccatcttgcagtcactgggtccacaagaggggaaccactgtgagaaggtgtcctgtgaccaacattgttgaggagtatctaaagggtgaattcagggaggttgtgctacagccttaaaaacacataaagtaactcagcgtcatcctttcttgttcacactggaagaactgaagtcaatagctggtcctagggagatgaataccaatatgagagatgcaggctgcacagacctggaaacagcttctgtggcttcgctcaggaaagaagccagacagccttctctcagggctcctgcaagtgggattcctgccctgcgggttcccaggtgaacacaaaagtcagttccaactctaaaattatttgtcattcggtacaacaaagataccactgcctccctagcaatagagttttttgtttgttttttgctttttgagacggagtttcaccctgttgcccagactggaatgcagtggcaccatcttggctcaccacaacgtctgcttcctgggttcaagcgattctcctgcctcagcatcctgagtagctgggattacaggtgtgctttatgatgccatgctattttttttttttttttgcatttttagtagagatggggttttgccatgttggccaggctggtcttgaactcctgacctcaagtgatccacccacctcagcctcccaaagtgctgagattataggtatgagccaccatgcctggccgcaatagagttttaaatccttctagaaggtactccctgagccaaccttgcactctctttgcaccccatggttattctgatgaggcagccattcaaggccacctgggctggaggcctggctgctccgagtgcagccctgctccactacatcagcatcaactggagcttgtttggagtggagactcttcgtccctgcaccaaccatcactgcagttttgcagggtctcagatggttcccgtgcacatgaaggttggattcccacatgaaaggctgtcatcataacccacctggaggagctttcagaagactatggtctaggtccttcctcctcccctccacccattgttcttggtgagccctaggcattgccagtgagggtttccaaagctctcccagtggctacagtggcagccagcattgagatgccctggtataaggccacagaagccagccacagtgaccagccctcctgagggttggccatgaactgatctctagggctctgttgagccttttgaacattgtttagagtaagaggaaatgtagttgttataagaaatgctcaatgttccagaagtgctatgagttactagaacaggaattttcaatggcagttttattccagtttgtccccagtgcttcaagagagggttgggtagggctttatgtgtttggggaagttgctgaagaaagcagctgaataactgaatccttttacttataaaaaggttcaaagttgtccagctgaaatgctgaggttgggagccttcaaattgaggacctcagggttctccaaacagaaggcttgcaagttccaggctgaggctaggggagctgtctgtgtctgtggcccccatgggtgattggtcccctctgtctgagcacgtgcgcggaaaaccatgctccgtgggttgacagctggtggtttgcttatttgcttgttttgaaaatgtctattttttaagactctattgtagctgaatttaatataaatgctttcatttgaacatttggccatctttctttagctaacatgtgctcttatttttatttagcctatttttaaccattgagttactacaaaacattatctcaggtttattttcatctgttacatgttttaaactgtagccatctgtgtctgaaacatttttatctgctacaagttaatattttaaaatgttattaattgggtaattatttagctgtcttcaaaaaacaaaaacaaaacagcaatcctgcttttccagctagtgagcagaaagtcagggcggtggggagtgtgttgtctgtccagccctttgcttgggacgggagtggtctcttgtgcttccgtgccctggtcttacctcaaagttactttcttaccttgaagacccaccattaaatataaactaatcagcctatataaacacaaatataaccagtaaaaacaaacaaatcaaactcatcataagtataagcttttagaaaagactgttgtcccaactttgacaaaaaagtggcatagtacatcatttgaaattcaccatactcacatggatgatgtcaccatccccgccctcagactcattgtccatctgttaggaagaggtgcacccaccacaggcagagcacagctacaggcccacacacacttatgccgcactggagaaaccgacctgccagcccagctcatctccttgtttcttgaattacccagttcatgtatgagaacaagaggaatgtgatctgaaactccccagttaacaagctgtaaaactgcttgacgcctgccaggctgtgcgaacaaaccaaggggcaggaggtgagggcaggggcggtggggtggggggttgcattctggaagagtcccagggtttcctctgcatcccttcggtgagcttagtcgcagtaccttagtcacagccaggtagctgccgttctcccattcccaaaggacaaatgtactaggatttgttaaaaagggaaaaatcctctgcatctagaaccaaatacctctctcatctcttccctgatgggagtaatcattctgcacctcgagattgacttgatgtcttaacttttgcattggatgatgttacctatgttgggagttacatcggaaccggcacagtagttgtcaacttcagctacatgggaaaattcatggaagaagcttgaaaaaatgtaggcacccagctgacattcattattgaatgaagtcataggataagcttctttctattagatttttgccccagcactcagatgacctccacaatctacagacaacccagagaagtgggagggttctatcagtgagttacaccgggcttataccaccaaataactggctcaactggactcagaaaatgggctgttcatttgacttggtgtcaggctgaaaggaagcagcttcatccaccattatgtcaagacatagacgagttcagaaattcattgcaccgtaggttattgttgagccacatggaattaaagggcttgcccaaagcagatacttctctggattttgccaagctaggcagtcacacttcccccaaaaagaaaagtagaaattagacaaaaataaactttatagcactagaaccaattttaatgaaccacaatcatgatacggatttagtagagaccataaaatccacaggacaaggtgcgatctccacttgcctttggtcaaagctgagaaacaaagaaccggaagagctcactccattgtgtcctgttttctatggagagatgagccccccttcttctcttcctgtgaaccagcttgaatcggaggggaacgtgtaactatgaggttcagatcacactggaacacagcgtggtccatttatgctcagagtccgccaggtggcatggacttcagacagcacagataccctaattaccatgcctggtcttgcggttcacattcaccgtccttcttaaaagtggggaagggggccaggcgcggtggctcatgcctgtaatcccagtactttgggaggccgaggcgggcggatcacaaggtcaggagatcgagaccatcctgactaacacgccacggtgaaaccccgtctctactaaaaataccaaaaattagccacacgtggtggcggacgcctgtagtcccagctactcgggaggctgaagcaggagaatggcgtgaacctgggaggcggagcttgcagtgagccgagatcgcgccactgcgttccagcctgggcgacagagcgagactccgtctcaaaaaaaaaaaaaaaaaaaaaagtggggaaggggaaagggagccttgtctctatcttccggggtaagcctgcgctgctgggctcctgacaggttccatagactcctcttgcagcacctggggtgctatcttgtcacagcttataacctgctccagagcctggctctgagcaaaattgctgaggctgaaaaaagacagtaatgcaactcaggctgctagggtgttctcactgacaggactgcagattctgtttggctgaccacaagttacaaagatgaagacaaagtgcgagcaattcaagggccagcttgactagctggtaaaacgagtggcaaatgtactaggatttattaaaaagcggggaaaaagattccctgcatctacaaccaaatacccctcccatctcttccctgaagagaaatgattctgtaccttgaggttgaccggatgccttaacttttgcactggatgatgttacatatgttgggagttacttcagaatcggcacagtggttctcagcttccgctgcacgggaacgttcatggaaagaaatttaaaaaatgcaggtgcctagcttgcaactgcagagattctgacttcactggtccgcggcaggattcctgctcttagatttaggtaatctgagagttccccccaagtgattgcagtgtacaaccatggtaggcaccgctgcttaggttgaatgacatcagcagaatgttttaaatcaacaggtttcatgagtttgagatggaagaattgggtgaggtagaacccattaaaatagttaaatgggataaaaaaaatcagaaagttgaaacaatgaaaggcagatgtgactttgtaatcatcaggacatttagatttgcccaagtcccaatacaattccctccctgtgaagccttagaaattcctcagaactgtctttagtaatagaggcatgcaatatgattggcagatgaatttacagggaggagtttgagcacgcatggaaaacgttctgattttgttgtctttgagatgctcttcgatgtcacagaaggaaatgtatgattagtgtcggtgttcttgtcaagagatggctctcttcctttcttaggggaggaggcaacgacgagctttccatgtcccattggagttgttgagagacagggactgacaagatcaataattgtttccaaataatggggcgcattagcagcttcccagggtcatgctaaggtgacaggtgggggcagatgtggacagagacccggaaggatcctaactaaaagggaactcattatgtgtgatggtccccttgccagccataggagacatttctactagccttggttaacctggagccacagtgtgatggcaacaggcgctaggccatgttttgagttagtgtaatttcaaagtgtacagtttaccaaatttgaacttttttttaaattttattttttctagtctggcttttgcaagtgactctgacaaaatatttctgcattcaaatatctggcatttctataacaatttgagaagcttggccttataagaaaatctccaccaacacctggtgtatgttcatgtgctttataaatattaatttcattgaattgaaaagccaaaagtctgtttttatgatataggtttgttttcttgacttttctccaaaattattactagagtctcattttttaaaaagtctgacaggaacatacccaacatatatttttaagtaatacagcagaagaggaaacaattagaaatcagagtgtgtagcatgagtaagtgtaaatataatttcctgaaatcttcatttcaattgtgtgtgtatgcaattagattgtaaaatttattattgattgattgattgattgatttttgagacggagtctcgcactgttgtccaggcgacagtgggcgcgatctcggctcactgcaacctccgcctcccgggttcaagcgattctcctgcctcagcctcctgagtagctgtgattacaggcacctgccaccacgcccaactgattttttgtatttttagtagagacagggttttaccatgttggccaggctggtctcgaactcctgaccttgtgattcacctgcctcggcttcccaaagtgctgggaaggcatgagccaccacacccagccgtgaaatttactttatactgtggaatgtaagtgaaattctgaaagctattggataatggcgttgtttagaataataaccttatagcgtaaaccacaaacatgaagtcagccgactactgcgatgtatgccaagcacaggaatctggagaagtacgagcctcctggctccccactggactttttattggggtgctagaccagtggttctcaaagtgtgctccccggggcagcagcatcagcctcacttgggaaattcctagaaatgcagattctcaggcatcctatcccaagcccaccgaatcattatctctgggggtgaggctcagcaatctatgttttaacccttttcctgtttgctttgagaatgttctctggcagcgcttgcggctgcagtgtttactccggataattttgccacgaaacatctcacttttgttactgtttttgcattgttctagcatatcgtctttggaaacaaaagacatcattctatttacagcattctggttttagtagttgtatttccatttacaaaacatagtaattctcgatcgctgaaaatgtcaaatcctagaaaacgtagcattcctacgcatgatgttaacatcgttcgcaacagttgttgaccaaagattcattagatgaattaaattttcccaaagtagatgattctgatgttagtaacaagaacagtttttatatttcactttcaaattgaaaatcagatttgcttcagcttcaaagagcatgttaatataaaattaaatgagcattgacggcaagctgcatttttttcctaaacaggaaaagggttgagcctcgcaggtggttctcttctgatatgtggcctctgagagaatacctggccagccaggtatgaaggtggaccatgacctccctgtctcagctccaggcctgcgcaatatccatcaatcccataggcatttaggcctagaagctaatcatgatgggtgtttcttttgtttgttcattcgttcgttcgtttgtttttgagatggagtctcactctgtcacccagacgggagtgcaatggcccgatctctgcccactgaaacctccaactctgggttcaagtgattctcctgcctcagcctcccaaatagctgggattaaagacacgcaccaccacgcccagctagtttttgtatttttagtagagatgaggtttcaccatactgatcaggctggcagtgttttcttctttacttctgttgctgaagtttgtaactaactttgtgtcaactgtttatttatttatttttgagacagagttttgctattgtcacccaggctggagtgaaatggcatgatcttggctcactgcaaccttccgcctcctgggttcaagcgattctccagcctcagcctcctgagtagctgggattacaggcacccaccaccacgcccggctaatttttgtattagtagaggtggggtttctccatgttggccaggctggtctcaaactcctgacctctggggatccacctgccttggcctcccaaagtgctgggattacaggcgtgagccaccacacccagcctcaactgttacttgatcaacccttaacagaatgtggaagttagtgaattgctaacgctgcccttggcctgctatttcccagctggcctctctgtgcccagcccagctctgagctgccacatgtcccctgcctttcaaagaatccaccttctggcctgacttttctagctaaattttacaaaccataattcctagctttcctattttctcagaaaaatgtccaccaggtgtttattcaggtgtctcattgttataatccaataaataaacacatcatattcatgggatagcagatatatgcatttatttatttatttatttatttatttatttatttagatagagtctcactctgtcacccaggctggagtgcaatagcacaatcttggctcactgcaacctccgcctcttgggttcaagccattctcctgcctcatcctccctagtagctgggattacaggaacccaccatcatgcccagctaatttttgtattttttgtagagacagggtttcgccatgttggccaggctggtcttgaacccctgacctcaggtgatctgcctgcctcggcctcccaaattgctaggattataggcatgagccaccacgctgggctggatatatgcatttaatagggactctttgatgcctgagggctcatgttatcaattgtgaatacaagacaggcctatgggaggggtgtttattttttgggggggaggggggatgggcagctggatgggagttgagagtggtctcatgttcatcaaatcagcccaagtagatgattgatttctctgcctcagtcagattttgtgacaaggtaaagcagtagattcttgagtagttgataaatgatattacaatcttttctaaatttaaactcttcgttgatctttgtcctgtttgtataacctttatcttttttgaaaaatgttagttcagcaactgtttagtttaattagctgattcattaaacttgggtggtggctcaccaataaaaaagcatttgaatgtttgaatgtcactcagagctcttcaatttctttgcagaaatactcaacctagattcttttaaattctctacctcagaacctgatagaatacttgcatatttttactgatgatgtttcacctatacttaatgtaataagtaaacacactacacgagaagtcattctgtaggaaagtgagtgcggatttctaattacttaggcacagctagtttcctagcctgacaggtgtggaaacacctttcacactcgaagcatgcagaggcttgcatgagctcacctgagcattctgaggagcctccctatgcagttttggaaccctctgtttgattcaaaggtctgctcctgataccagggaggttttagctttctgccaaaagaaatgctctttcatcttcaaatcaaatgttgaagtgggccgggcatggtggttcacacctgttatcccagcactttgggaggctgaggtgggcggatcgcttgaggttaggagtttaagaccagcctggccaacatggcaaaaccctgtgtctactaaaaagtacaaaaattagccaggcatggtggcaggcacctataatcccagctactcgggaggctgaggcagaagaatcacttgaacctgggaggcagaggttgcagtgagccgagattgtgccactgcactccagcctgggagacagagtgaaactctgtctcaaaaaaaaaaaaaaaaaaaaaaaaaagaaagaaagaaagaaagacagaaaaaacaaacaaaaaaatgttgcagtgaaaaaatatcacctcctcctactctcaggatggtacttctgcccattctcctgagtaggctcaagcttctgaaaggagagaaagtgggagtggttgatatttcgtgactctcactggcgaaggcccacttgcagactggccctgcatcccgctgtcctgaatgcacacgtctgtgtgccgtgggatggcctctagagcgattcctccctgaatccctgcaacagacacctctgagtccaggcacagcaggatttcaggaaccagggaggagctggccaggtgtacacccgggcagatacctgtgacccgtgatttcaggggtgacagaaaatgcctcttttccaaacaccaagcaaaggaaccaaaaccaaatctacacaaacatgacctttccctgtaactctcctgattgctttcatcctgtgctttgaaacagggaaaatgcgtagacataccgggaagccagaggggccgtcgtcctggttttatgatgcgggcaggaggaagttatcaagggccgtccctgaaaacaggctttatttggacagtgtgagggatgtaaagaggagaaaggcagaccccagagagaacaggtgccctagcagagatgagaccaccccccggggagtggggagagcctcaatcagagtcccttactggaggtttgctctggggcagccccagtggaggttgctgcctgctttcatgttgtcggatcacattctccaggcagaaatggtttggaggatcctgggatttgaaggctggtgctcgctaatcatggctatgcatgaagcgtaacacagggcggtttgagtcatcttcctcggggagttttgagaggaacctaggatgccttattaggaatgaggttattgcagagcatggattttctgaaagacaaggcaagcacatggccatctggtcagcactcaccgctccctcccctgccccaccatgagtcgcccccaacacgcagtgcctgtgctgaacacactgtgcctggccgtgcgtgggcagtcacttcctagcccagctcccagactggggtcgccctggatgacagcatcacccttgtgccttgttcatttacctattcagatatgaagtcaagatactgtgggtgtccagagatgcttttttaaaaattgcttcctggggaataaaaaggaatggccattaacacattagttgacatgctcaaaatttaatttgcaaacagaagccaaaagagacagctaaaacttttcattggaagcaattaaaataggaaagcaacgggactgaacagttgatagtttgccagtgcaggttctgctctgtgaggcacgtccaggaccccctgcatcagtgtaagtcggcatacaggggttagagtgcaccatcctgggaatgcatgacacataggtgtgcttggttacagaccagcttccccaccacccaggctgaggcctttgcagacagaaatcaaacctacctggattagcacagccctggggactgaccctggaaatggagttcgcgtctcttcccctcttggcctgtctttatcactcacagctcagttagtgcctctcggcatctccttcctgctgtcttgccctgcaccatccgcttcctctctcgttttctttcttcctcacattctttcatttaaaaaaaattccaagtatgagcaaaaaataattttaatgggatgaatacactcaattatggtcttagttgtgtgcttaaagggagtaaacttagaatgtgaagagccagaactagaaggttcacagtctgtgtagtctcttcctaattaattcatttttctgtaagggccagccttcaagaaaatgtagaaataacgatttaattctattttattctttttttatttgattaataattactcaattagatccccatgactttatgtaaggagaggccatggtgtttgcttcgtgaggcggttgtgaggagccatctctgtgaacgggctcctggccgctgaggtgcatttcacaggtgctcatgctagctccctcctcagtgtgggcttggccttgcaaatgggcacaatttgcactaaatgcagactcctatggattttgcaggtagattctagtttttctgaacaatttttgcatttatttctgcatgcgctcatttaaaaattgtgttgttgtagtagagcatgcatactaacattgaccatcttagccatttttcagtgcccagttcagtggcatgagggcatttacactgctgtgcaggcattttccaccatccatctccagggcttttccttatcccgaacggaaactgcgctaattcaacacgcgctccccattccctcctcccgcagcccctggcacccaccattcaactttctgtctgtgagtttgatgagtctaggaagctcatctcactggaatctgatggtatttgtcctttgtgcctggattattccgtgtagcataacatcctccaggttcatccataggttcatccttgttgtagcctgtgtcagaatttcctacccttttaaggtggtgagtgctaagttttaaactgattgccttataagccaaaatgttagaaaccagcctattttcacacaggaggctgtgcttccagaaatctgcctaaccctgtcacgttgctgtgtcacgccatcaggctcttaatgagagcacatgaagaaaccacagattttggagttagacagactccagttggaatcctagctccacaaccacctgctgggtgaccttggggacattatttcatgtttacgagattaggacaggaatagtaaatacctcatagtgttttgtggatcaaatgagctaaggtttaaaaagtgcttagctagcaagggggagaggtcagcttcctaagtgtctgccctcccctggagtgtggtatcatcactgtcactgttgcacgtgagccattttaaggaaaaggtgtgtttttcaggttatctttcctatgccaagagccataggagtgcattgacacgtgcagaccccgcaggaactgtgcattccccgatggcaaccgtgttcactcatgcttctgtctttcccctccacactttgagagaatgggctgacattataggttttttttttcttttctgtttattttttctttttctgttttttttctttttttctttttttttgagacgcagttttcctcttgttgcccaggctggagtgcaatggcaccatctcagctcactgcaacttccgactcctgggttcaagcgattctcctgcctcagcctcccaagtagctgggactacaggcgcctgccaccaggcccagctaatttttgtatttttagtagagatggggtttcaccatgttggccaggctggtctcgaactcctgaactcaggtgatctgcccgcctcagcctcccaaagtgctgggattacaggcgtgagccaccgcgcccggccgacattatagttttaattaattctttcaacaaatatctctaagtactcattatgtgacagacactttgaaggcgctgtattgaagcataggaacttggtcctgagcaaatgagggacttaatgagagcacatgggcttgcaaaccgtgaacccatctcagggactggaaggctctgacaaaagaggagcgtgagtcccggggaagagagggcagacagttctggatgtggagggtcaagaaacgcttttttgaggaggtgacatttgagcggaggctggcgtgaaatgggggagtggattatgaagagtgccaggggaaatattccaagcagagggaagagcaaattctagaacccttgagtggctatatgcctggcacaccccaagggcaggaggtcgaccacaatggcgaggggatgttggcccgggtggaggggtaggaaatggagtgaggcaggacccggaaaggcaccatggctgcagatttctatcagctgacctttattcactacggttttagtatgagccttgttacagatgaaatgttgtggaggtcctaacctccactgtgctagtatttggaagtgaattatttgggaggtgattagggtgagatgaggtcatgaaggcgtggccccatgatgggatcagtatccttataagaagaggaagagacgccagtgctttttctctgtctccatccaatgtacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggacgcagagtgaggaagagtcacttccttcacactcaggagcacatatactcacctgctggcccacctcgaggggcccagctaggtcagtgccaggagaggcaaggttggtgcatttcacattacccccactgaccccaccactggtagctgcctgggccccaccagccttcccggaaaccgtgtgcatttgcacttagccagacagcacacggtgagaggcttatttgctcatatggtactttcaagaatctgcagcattgggtaatttgctggccatgtggagattcccatgtgcggggaagggctgctgggctgaggacctgagcagatggtggtcattaatagcaccaacatgtgaccagctgtaattgtgctggaaggactgaagccactgatggttgctccgtactttggttctacttaaaaaatacttttagcaggacataattcattatacaaggcagcattagcaaagaaatatcagactcccagtaagtgccattttcctacccctgtgttttaacaagtattcctggtgtttagaaatacatagtctctcagtcatcgtgtgggtaaaagtgagaagagttgtttttctcagtggatcaagactaagtcttatgagatttgaaatctagaagctctgctaaaattgcatatagcaatgcctgtgaatatgtgaaccgaatgagaaacacatttgtgtcctagagcagaaacttagattcagctctttatacacacaatgacccctcctggttaattgacttgcaatggtagtttcaggtatccagcagtagttctggctacagcagatctgtctacccactgcctctaaagctaatctctccagttaatagcttgcagcctgggcctcattaagtcaaagaacttctgcccatacaataggctgtaatcctctgtattagtatgaggtaatttggctcctaactggggaatttttctcgtctaataagaggagaaattgtttggtacagtagaaatcatatagtttcccagcatttggctcttggagaaagtcagggattctgtatcctgttccttacctctggagggattcttaagttgttttgggtatcttacagcaaacacttttagtgacaaacaagtcaaattaataataataataaaaaacctaacagttgttgactactgcgtgcttaagaagagttctgagccattttcttgcatgaactcataatgcccacaacaactctctaaggcaggtattcttatccacatgttgcatacgaagaaactgaggcccagagtgattaagcttcatttaaaaagcgtgaaatggggcagtgagtcatgaacagtgccggaggaaatgttccaagaagagggaagagcaaattctagaatccttgagtggcaataagcctggcacatcccaagggcaggaagtggaccacaatggtgagaggatgttggcccacacagagcggtaggaaatggagtgaggcaggaccagtatcgtaccagtgctaagataaaagcccaagcagtctaatttggagtccagactcttgatcattgatatgatttggctctgtgtctccacccaaatctcatgttgaattgtaatccctagtgttccaggaaggaccaggttggaggtgattggatcatgagggcagtttccttcttgctgttctcctgatagtgaatgagttctcataagatctgatggttttaaagtgtgctgtttcccccttcgctctctctcaccctcctgcttcactgtggtaagacgtgccttgcttccccttcaccttccaccatgattgtaagtttcctgaggcctccccagccgtgtgaaacgtgagttaataaaatctcttctctttttaaataaattacccagcctcagttagctcttcatagcagtatgaaaatgggctgatacaatcactattcaatatagcttctaaaacatacatttgtattatagcatgctagaccaggctgtgtgagccacttgggcactgcatggatttgggtgagccggggaagatgtcaaccccactgtcagttgttatgcaaaggggagccttgtcttcatcctaagttgaaatcttagggactgtctcttctggacataatagaagtgtgtcctgtgtccataattgtaaataaacttactggcatatagaaacagtgcctggtgagctctttttgaggatagatgctaggtcttctctttcattctcaggacccagcacaatggtggggccactcaaatgtttttgaatgaatacatgccatttttttggaagctgtgagagtttatacatcatttttcacctattgccagacatttgctgtctccatatcttactctatacatgaaagcagaaagtagaataagccattgtatgatttcagagggagaagtgaggaaatgggaggtagctgtgtaaaattagatataaactaccatcaaaaagtaattgatttaaggccctcttaaaaacacattgtcttagctttggctgctatgacaaatgaccatagactggatagcttaaacatcaaaaagttgagaaaatttatttcatacaattctggtggatgggaagttcaagatcaaggtgcccacagacctggcactggagaggagggctcccttcctggtttgcagatggctgccttcttgttgtagccttacatgtcagaaagagagagagaagagaaaactctcctgtctcataaggacactaatctcattcatgaagcctctaccctcatgacccaattaccttttgtattagtctgttttcacactgtcataaagaactacctgagactggataatttttgaagaaaagaggtttagttgactcacagttccgcatggctggggaagcctcaggaaacttacaatcaaggcagaaggcaaaggagaaccaggcaacttcttcgcaaggaggcaggaaagagagcgagtgaggggaaactgccacacaattgtaaaccatcagatcttgtgaaaactcactcactatcacaagaacagcatgggggaaaccacttccatgatccaatcacctcccaccaagtccctccctcaacgtgtggggattacagttccagatgatatttgggtgggaacacagagccaaaacgattcacctctcaaaggctccacctcctactaacatcacattgggtgttatgatttaaacatatgaattttgttgggggacacaacattcagtccataacacatgtgttgataattacaactcggttccaagaggtgcctccataaaaggtcacagagaccccaagaacagagctgcctagagttctattgcagaactccagggttgcagcaattaattttacatctaaaatgttgctgtaagaatttaccccacaaaaattgatcaatgggatcacttggacacagggcagggaacatcacacaccagggcctgtcaggtggtggggggctgggggagggatagcattaggagaaatacctaatttaaatgatgagttgatgggtgcagcaaaccaacatggcacatgtatacatatgtatcaaacctgcacattgtgcacatgtaccctagaacttaaaagtataataattttttaaaaaaagaatttaccccacaaaaatgtgggagatgtaaagagaatagaaagcttgtctttacagaagaatgctccctaataaatatagaaagcattgtggatatagaaaagcatgattatgcaattcccaatatcataattgattaaaccaaaaattagtgaatgctaaaaattattgtcatagattattggggataagatatccatagaatattcatgtgtaatttcacagattcttattagtttaacatgaaaatattacctgtctaatggagaggtctagtggacacaacttaagccaatagccaaactaagcattgccaatattgggtcaaaatatgcgcttcctgatatgaagccatctgccacccaaaatgccacttatgtacaattactgcccaaaatgtttaagtgaatctaatcatgaggaaacaagcagagaaatccagatgtgggcccttctacaagataactggcctgattcttaacatcaaaacaaaattaaaaaacaatgtcatataagcaaaaagaaaccaaccaaaaagtaatgaggttgaggggagaatatactaaattgaaaaaacacacacaacattaaccttaattgtttcattgattaaaaaaatagatgcaaaagacattttgaaaaaattggggaatttgaattggggctgaacacctgtgttgaatgtattaggtgtggtaaaagaggggtaagagtagggttgtgttagaataaaagaaggtccacattgggaaacacacgctgaagtattttggggtggtgtttgcaaattattttcaaatggcttagcaaaaagagtgtgtgtgtacacacaaatgtgtacatatatgtgcatatagagggagagagtggaggcataattgtagtaaaatgctaacattggcgacatctacatgaagtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgagggggatcctggtgctgtgagtgtatcacaggtgatgtggcaaaggtgggcgtgggcaccagatacagacatttccagtgggatctcgttgtactttcatacatgtcactgccggactctgtggtcttaaaagccatgaagccagcccaaggacccttgccgctccatgccaggcagcctcctggccccgtctgactcgccttagggggtgccttttactccgttgtgtacaaagcattttgaaggaagagaaggaactaacagttagtgttgtcagtattctcagaattttggcaatatcccataataagaaatctgtttgatcaactcatatacacctacacatgtaatgcctctatatgggtctgtgtgtacatatcggtatgtatagctgtgtgagaggatctatagacatatgtgtgtatgtgtgtatacacatctataatgtatgacaaaagtttcatcagaccatccgtacgctcacactttgatgtttactaacatcaaagcattagtaaatcagtatttcttaatgcgctgcttgttactggtttaggctacttatgatccgaaaaatgctggtttcagcaacacggaaaacataaaaagataattatagaacagggttaggaaaccaattctgtctgatgtgtgtgtattattacatgagagtatttgtatgtatccatgtatgtgtctgcatgtgtgtgtatttccatttatctttgcaatggtgcagggcaactgtgggtctgctgccattgtgacttgtttctgtcctctcctgggccgggcccttcaaaaactgtggagggacatttgtcattggtgtccgagcttctgtgctatttctccagaggggtcatgggatgacacagagaggccctgtgctgcaggtaaatctggaggacagcttgcgcccagggaaattacatgcaaaccaggttttcctgtcctcttgagtggggcttttttctttcagaaacccccctttttttttcctttttttttttttttcaatgatctctgcagaagcagcagcatggggctcaaatttgaagtgagccgcagatgcaggtttgcttgcgagtgactccctctgctcaaaatcgtccgcattttttttcttcttctgagacagggtctcactctgtcacccaggctggagtgcagtgctgcaatcttggctcactgcagcctccacctcccaggttcaagcaattctgcttcagcctcccaagtagctgggaccacaagcttgcgccaccacagggcatcctgtatttcaagcttcccccttttgaaatgaggattgctgacggatggtgtgcaaactttagaacttgttgtcaagatgtcagttgaatcttaattaaccattgaggcagcctgggagatacgcctattctggtaggaatttttattctttcaagttcaaggatttgtccttcatcattttccaatccatgggatggtaacaataaaaatagctaatagctaacaaatgtttactctgtgctgcgctcagcgctcagcgctcttcatgtgttttttctcctttatttgttagggaatgaatgagctcactagttgccttcttctgccataatttttcttccttgttcacatgtggttggtggtatatattttagtattcctttttgtttgtttgtttttgagacagagttttgctgttgttacccaagctgtagtgcaatggtgcggtctcagctcacctctgcctcctgggttcaagcgattctcctgcctcagcctcccaagtagctgggtttacaggcacgcaccaccacgcccagctaattttttgtatttttagtagaaatggggtttcaccatgttaaccaggctggtcttgaactcctgacctcaggtagtccgcccgccttggcctcccaaaatgctgggattacaggcttgagccactgtgcctggccaatattccttttaaaatctcaaacctgccaaaacatacaggagggagaattattagctcatcagattcagtatatcaaaatgaacctgctgacaaggtggaacataattcacagactacagctgttattaatgtgtgactatttctggcaaggcccagggtgcacaatcagaaaactattaatatataacaggctgaagtggaaatgtgaatgagccaatacttggaattcctatagtatttacactaactgttcctctgcccttctgaactgagtacttcgcaactcataaaatacaatttcctgttttccactttgcagcctcttcacatctcctatttcttctggctcctctaattaatggaaacacttgcatttgagttcgcatcgatttgcaaaacattgtttaatatgagaatattttcaccgtcgagggcatgttgattattcctaggtgtaaaacattctagtcaaatttaatataagaaagtaacatgcattgtcaataattacatgaaaaaatatggtggaagatttttttctctgattaatgactcaacagttttaaacatgtgttagtgggctgggcacagtggctcacgcctgtaatcccagcattttgggaggctgaggtgggcagatcacctgaggtcaggagttcgagaccagcctggccaacatggtgaaacccagtctctacaaaaaatacaaaaattagccaggcatggtggtgcgtgcctgtaatcccagctacttgggaggctgaggcatgagaatcgcttgagcccaggaggcagaggttgcagtgagccaagattgtgccactgcactccagcctgggtgacagagtgagactctgtctccaaaaaaaaaaaaaaaaaagtgttaatgaattctttaaaataatacccatctcttcgattcatgaaaggattctttaaactcctctgcaagagcctgagtctgcccagcatcacggtgatggcctccatggtccctcttgctcagggagcagctgctttgcacctgggactctgcacgctcaccccattcagtctcccgggtgctccctggcaggtgcaccatcatcctcatttgatggtcgagactggagcgctaagagcgttggtgcacactggtgggacccaagctcaggtgtctgtgagacaaggactctgccctccagtaatgaggaaggtggcatcccctgtccctcaggaagattattgtttatttgaggaagtgcggtgtaaagacctgaatcaggaaaggacaagtcaaggcattgtggcatccaatggcatcttaaatgcctctgggagaaggaggtcactgggattgagaacattcagaaaagatttgtgggaggaggctgaacttgggcagacacttgaatgaaaaggatgtggggagtggaaggagcaggcattccctgcagtggggtgctgagattcagagaaagaagaggtgcagggtggtgtcttgatgaggcactaagaccagctcacaggccgatgagggtgagatctcgaaatctgtctgttgtcacactgcctctctatactaacagttttttagtgaaaaacacagtgagaaccagataagtgagttcactgaattttatttccaaaaaaatggaaagctctagtaacgttctgcagtaacactttggctcatgtctaagttctttttttctttctttctttctttcttttatttttttttgagacagagtctcgctctgtcgcccaggtgacatttctcacaatagcaaaagtttgaaatatgagtgttcatcagtagtggaatgattaaattagggtacatatagacagtgggatactctgaaactgttacagatgatgatatagctctaaaggaaattgtctatactatattcttcagtgaacaaggtaaattagaaagtattatatagttttttaaattttatttatttatttattttgagagggagtctcgctctgtcgcccaggagtgcagtggtgcgatctcggctcacggcaagctctgcctcccaggttcacgccattctcctgcctcagcctcccggtagctgggactacaggtgcccgccaccatgcctggctaattttttatatttttagtagagacagggtttcaccgtgttagccaggatggtcttgatctcctgacctcatgatccgcccgcctcggcctcccaattttttttctttcttgcattatgcatttttcatcaaatgcttggcttcgtgccttctaccatgaagaccccacttcacagcgacacatgctcttgggtcactccgccacccgtggggttgtgaatcaagttcttcagggagagaagacaagctgacaggggtgggacttgagttctgtgcatctgtgatcagattccgcctccacagtgctgggtggtgggaggaagcccattcatctctgtgagactaaagtccctcatctgtcaatcaagatgctaaattttatttatttatttatttagagactggcccttgttgtgttatccagagtggtgtgatcatatgagatgctaaatattccctcgtgggttgtcatgaggttcagctgcaaccctggctggcacaggccatgacacttccagcaatgtacctgcccagctgggattaatcactgacatttaactcccagttgatggcacctgtgtacggatgaattcctcaaaacagtatcagaatcttacgtactcactggtctcagcgagtattcacagagaaagcaagaaggatggtatttgattactcaataagtgagtcctgaggggtcattgctaggcaggctgaggggtggtctctgcagcccctcacagcctttgaacagccagaactttgattgatgaacaggtgctttcctgtaaaaagcaagaagcactatggaatcacagtttttgttgattttttcccctgctggtagtctggtcttcatgatatcattcttccagaaagccaaccctttcttgcaaaagtacaaggtgtgctcaggaaaaatgctgctagtgccaagattcctctttccatttctgtggccctcaggtgtggacatcgctgccttattttccctaaagtgacaaacaggatcacatcacatatttaaactctgaaatcggtattatgaggtttaatctgtatccatgtaggttttatcttgttgcaactgtttccatcctctcgcatttccagtgcccccatattgaccaggagcaccatctaggcatccgtttgtgttcctcctgccccccacccccaccatgcttctgtctgtcttctccatgagtaggaggaggtcacttggatcgagaacattcagaaaagatttgcaggaggagactgaacttggagagatgcttgaagggaaaggatttggggggtgtgcaagagggggcattccttgcagtggggtgctgagatacagagaaggaagaggcttagggtggtgtcttgatgagacactaagactggctcacaggttgatgagaacgagatctagaaatcggactactgccatgtcagctcacttcatgaatatcatgaagaccagtccaccaggaggatccaacaggaaggcaacttttttaagcaaagggattctagctctccactggattaccctgtttcatatgtaaaagttaggttaactcggaacaggagatgcaaaaaccccatctacttagagaaagctgaggagaacaaaagtagcgttagctggagacatatgccatttgttggagtgtccactgagctcgtgcaatactggttgaagccacttctcacagagatgaagcaccccgtgggtgagcctggaaataaaagtgcatggagccaggctgtggatgacggaaatagtaaatggcaaagcagaggagggcttgagcatgggtgggcaggtgagcaagcgtgcagggtgcagaaaccacagctgtgagaaggggcttttccagagtgaggttacagaaagatcaagtgaggcaggacagcatgtggacctggaagagaacataggcaaggggcgaaagagtgtggaaagaagagaaaatgaagctatatagacttcaagtaacagcatcattgctctagaactaggtcattcttggtctctgagctccggacaaattctgaagtgacctacatcattcatagaggcagaaggaggctaccattcattccagcaagcagggaaggctttcttgatatgtgctggtcccagactaagcctggaacacagtgacacacagtccttgccctcagggaactgaaagactaggaggggagggagtcatgtccataaattcaaaggccatagttgctgcaagatggcaatgagatgctaggagactataggtgggttttctagccaagtcttgggagaattcaggaaggcttcctggaagaggagacatccaagccaaggctgaaagagcaggagcccagcaggtgggtgggcccaggccatggacatagcatctccaggaggatcatgtgatccacccagactctcatctatgttgtttgcttttaccatgtagggtccctaccatttattttctcatatgagtgaagctgtctccttcaccagcccccacattatcatgtactgttttcatccagtcctctacagcctccccccaaccgagccccacagcccctgctgccaaagggattactgtaggctttgggacattctggactaatcccacgttcttcacccccttttatgtcagtcaccaggagaagctggtgactaaccacagttggtagctctttgtacgccataccttccccgactttctcttctgcttattttttctgtttcttgtttcacaatctgacatctcatgtgtctggaaggtcagctccatgaggtcaggaattgcctacttttttttttcaactgttgtacactcagcacctagaagagtacatggcatgcagtgggtgctcaaaacacagtgattgtgctgagtgcaaaggctcagcctgtaatcccatcactttggaagaccaaggggggagtttcacttgagcccagaagttcaagaccagcctgggcaacatgacggaaccccatctctattaaaaatacaaaaaactagctggatgtggtggtgcacacctgtagtcccagctacttgggagctcgaagtaggaggattgcttgagcctgaaaggtcgagctgtaatcacaccactccagcctgggcaacagagtgagagaccctgtcaaaaaatatatagtgattgaatgaatgagttatactgctaaatggtttaaacaattatctaaacattgtttatgttcttttgagactttgaagacattgactttcaaatccagtagtttccaaatttaatcatcagaattacttggagcactttttaaaaatgcccaagtcttccccccaaaactcttggagtagttacttcaggatatgcgactctgagattttggttttgattcagatataatccaggcattgggaccattttgcaaaggagagagtagaccagagataatgagtgcattatctctgccagggtctgctggggagaacctgccctgatgcccaggccagcgtgctctggctgcctggcttatgtctaacaggagctggagggcatgagggtgggacgctactgttcacatcacagggaagatgtgaatgggggtggtttggggtggagcgttgaccaggcttttaagagaactgtgggtttatgcctggtaatgataaaggaaagtagatttcaggtgcagaaaacatatccgttgtcatttaagtaaagttagaatcataggtctgagataatttaatagacttttccatttgtcaaagatgtatgtcttatttcccagtgatctctttccttctcaaatatacttgctactacaaatgacattccaagagcccatttcagtcccctgagcgttttgatttttctttcgagcagtagacctgctgtagtttaagctggttgggaaagctgtcgttcaccttgatggattaccgtccccgcagtgagcacccagtctccagaaagttcacggctccctcaccttatgtatctgatttatgtagaaacgtcgataaattagttaggagggcattcttgctgatatcagcaatcccagagcacctgggaggaaagcagagtgaagattttgaaagtcacaggcgatgtcggccactctcctgtgtggcccaggaacctcacacaatgataagataaggaagtttaatggatggtgctgccttctgaaagattaatcgtgccttgaaatctagatattttcatttcaggctgaaaacagtaaattagaaattaataaaaaggagatgatttcatcagctcaacaagtgcttctgatttcaagaagttttccttaaattttttttttcactgctgaaaaaaatcagtgtcttgataattttatgaagtagcctgtaattatttcactatggctttgcatctgagaactgaccatttgtgttttgaattcatgtcaaacaataatatattcgatagcattttatgatttattttagtgcctaaatatttataaaacaaaggcagggttttttattttcaaatttatgagctagataatgtcttgaagatgtacaacatagtatactaattttccttgcattctggcagtcctcaaaatgtaataggcaagtttattcttagacaaaagcccatttaattaaaactcacacgataactttcatacatagcaattgaattattcctaaaaggattaaatacctaagctttgaagttggatgggtgattattacaaaagccagattaatacaattgacctaatttctagtcagtgacattataagcagccttgtaagaatagctgttactacaaatatgcgggtttgcaatgttcaattctaaagtggtctaatttgttcttactacctgccagaatgtatgcattcaagtgggtgtcctccatgacagctttaattggtagtacaatggtatgagtgtggaaaggagctggtatttttcctgtttattcattaattgaacaattgattggtcatctactgcatgccagttagcttattaggggctcagatgcaagtgggggaaggtaataatcaacaaggaaatatctgtcatgtagagaaataaaggaaggtagggtggagggttaaagtaagacaggttcagtattccactggggatcagggagggctctcacttaagtgaggtaggttgaccatggattacctgggggcagagtgtgctcaagcagcacctgcaggccacagggaggctttgagttttgttctgagtgagattggaaggtgttggagagtttgagttttttttattctttgagattggaaggtgctgggttttattctgtgagattggaggtattgagtgagattggaaggtgttggagagtttcaagcagaaaaactgtaagatctgcagatgttttaaatagatgtctctgtaaattgtaaaactgtaagacatgggtaagaagcaatcattttcaggggtgagactgcttgtaggacttcacatgagcaaacgccaggcagagtgtggaacctggacccttcaaagagaaacgcaggtggaagaagcagcaaggaggaacggggcttagctgggccatcgccgccgtcttctctggcactgcccctgtgttttccgttcagagaaaagcctttcctagcattcatgacccccatcctgtatcatccaggttccacacggtcctcttctgagagaccctcccgactactcctgtgcccgttgccatgccatttgttggatcacttgcaggccccgagtctcaaacacatgatttatcatcagatcgtacagtcgtcagaagggtcccaccgtttctaaccatgtgacctgggcggttgctttacttctccgcacctcaatgtccttgtctgtaaaatggggcggatcagcccacctactgtttgggattaaatgaggtgatgtgcataaagctgtcagtgccatccctgggctgcagcgggcgttctggaaatatcacagattaccatcactgtccgccgcgcggcatccgtatgcccttgattcatacacagtgccacgcgtgggggcggttctcagtcagaaaataccaagagcagccgccgcatcttagaatttgctgtgttttactcagtccttttggggtgtcagcattttgttttctgtgtgttggcagttgatcggtaatttccaccgatgcccctgtacctcctccatccccagtcttcccagtctgcatggcttcaggtgtcacttctgggttcatgtctgctaaatttatgttggtagttttagactctcctaatcccctacttggcgttcctcatcattggtaggcacatctctgaatgtgcgtctttccagacccaaattcagctcgtcttaaactgtactcctcttaaaacctatttctccttaattcaggttacagggaacactgcctcccttagtccatcatttgggcagcttcggtcaataaccctcccctgtggttcctcttctctcagatttcatcccctctgtcctgatgaagcccctgcttctagcctctcaccagctcctcttgttcatcttggctatagatgcttatcagcaaagatgttggttcttcccaatggtgaggataaagtgtgggtgctgatgaaggcaggatagtgacctgatgtagggttctctgggtaaaacacaatgtttaggattcccctctagcacaaggttgctttaggtctcggagatcagtgcaccaagagaacagcaaccagcagtgacctctcctaatgacagtggtcatactagtatgaccatattaccagaagaaagaagagaggttgttttttaaagcactggagattccatgtcagaaaatgtgctattctggccgggcgcggcggctcacacctatagtcccagcactttgggaggctgaggcaggcagatcagttgagctcaggagttcgagaccagcctggccaacatggtgaaaccctgtctctactaaaaatacaaaaattagctgggtgtgtggcacacacctgtaatttcagctactcggaaggctgagacaggagaatcgcttgaacctgggaggcggaggttgcagtgagctgagatggcaccactgcactccagcctgggtgacaaaagagagactctgactcaaacaaacaaacaaacaactgtgctattttaatagatattcaactaagaaatgggtgggtgtaagtgatttaacctgaacccatctcagcagaaacctcagttgatgaactttttcttttctttttaaacccactttaagaagaagtacatgacaataccgcagcccctggaggttatttcatgcaggtggagagtggattcaccacatcctccagctctgagaccggtgttcagtgagaggtggttgtgggctttgagtctgtgagatcttcagtcatccaagttggattttgtttatttgacttagggtagatgttggaccaatacctcgtaggaaggtttttgaatcgggagttgaagcaaagcagcatttcttgttagtcctcagttaattagaaaattaaattaactacaatcctcattcccagagctttctgggtaattgatgtcttactgtatttggattagagaaggccccaggaggcacaaggttataattgtgtagaattagagaatctagggaagaaggaatggcaggtaatttgcaaaatttcaaggcagggggccctccccaaagtcccatggcaaaggcattgcttggtgagcacgcggggctgggccagaggctgcctactcgggagacatcagctgtgggtcaagagctacttaaaagagaattcaggagatcaaagtattgtcttccaccattcatcagaagaaaatacatctagatttaaaccctggaattagactggcttgatgcttttaatttgcatttaaagtcttaaactttttcttcttccaaatatttaccattttctgtagtccttttaagtatttggactagacttatttagaaatgtacagagtgcagaacaatgtagactcttgagtggctaagagtctaaacggctgaggaatgtagatcatttttggacttaaaatgaagctttaactgcccccaaatggaggacctccttttctggaagcaaattgcaatctgaatgctctgtgctaaagcttaaagcatagcaggagaaactattagaatttgtatagtagcattgccttggacgagcctagtgcaaactgagcctggtatgtggaccaagtactgtttatgacttttctttaagcataagttactcagggaaagtattatcaaaacaaatttggttataattgtcttcagacttgtttttctgggacttgggacttaaaagaggggagtaggctgtggataagctttggagttggcccacacaatggagattgttcaatttttttttttttttgtcctctcagacccagtaactttgggatttttattgactacttttttctccaatttttaaaattatggtaaaatatatataacataaaattgtccatcttaaccattttgaggtgtataatttggtggtattaaatgcattaataatgttgtatgatgattaccaccatctatctctgcaactcttttcattttgtgtagctgaaactctgtacttactaaacaatctcttcattcctccctcccccaatcgctagcaaccaccatccaatgttctgtctccatgattttgactactcttaagtaccttgtataagaggaatcatcaagcatttttctttctggactgccttgtttcacttaatataagtcctcaaggtgcctccatgttgtagcatgtgtctgaatttccctcaatttttagtctgaatagtattccattgtatgtgtatgttacattttgctcatccatttatcagttgatagactcttggtttccatccatgttttaggtattatgaataatgctgtataccagaagtggaattgctggatcatatggttatttcatttttaatattttgaggaaccatcatactgtttgccacagcatctctatcgttttacactctcaccaacagtgcacaagggttcagtttctccacatcctcactaacttattttctgtttgtttgtttgtttgtttttaacagtagccatcctactaaagaggatctcattgtggttttgatttgcatttccctaatgattagtggtgttgagcatcatttcatatgctatttggccatttgtgtaccttttttggagaactgtctatttaaaagttctgcccattattgaattgagttgttttgttgtattttttgagttttagaagttctctatttgttaattccttattacatatatatatatgaattgcaaatattatttcctctcctgtgggttgcctttttattctattaatattgtcttttatgcaaaattttaaacaatttctcgaagtcctatttgtttatttttcctggttgcctatgcctttggtgacaataaatcaatgccaagaaatcatggacaaaccaaatgtcatgaagttttgccctgtcttttcttttaagagtttcatagttttagatcttacatttaggtctttgatccattttgagttaatttttgtatatagtgtaaggtaagggtctagctttattcttttgtatgccaatatccacttttcctaatcatttgttgaaagaactgacatttcctcactgaatgattttaggacttttaacaaaagtcatttgtccatatatgcaagtttcttggctctctacttaatgcattgggattgcgatagagatggtgttgagtctgtatatcactttgtgtggtgccttacttcatttgggctgctatgacgtaataccatggactaggtagcctctaaacaacagacatttatttctcaccattctggagtctgaaaagtctaagattaaggcactggcagatttcacatctgatgagggtgtgtttatcatagatggtgccttctctctgtgtcctcaaatgatgaaagggacaaacaggctctttcaggccttttgtaaggtctctaatcttatccgtgaacattctgccttcttgacctaatcaactcccaaagtccctcacctcttaataccatcaggttggaggttaggtttcaacatacaaattttggggggaaacaaactttcatattgtagcgggtagcattgacatcttaacaacattaagtcttcccatccatgaacatgggatgtgtttccatttaattatgtcttctttaatttctttcagcaaggctttgtagttttcattttacaagttgttcacctccgcggctaagttaattcctaagtattttattctttttgatgctgttgtaaatggagttgtttttatcatttccttttcagattgttcattgttagcatagagaaattcaactgaatattgtgcatggactttgaaattttgcagaatgtactgattagttttaacaggattttaaaaaatgggatccttaaggtttttatatataaaattgtatcatgtgtaaacagatcattttacttttttttctgatttaaattacttttctttctttttttatttttggtctaattgttctggctagaacttctaatattctgttgaatcaaataagtggtaaaagttggcatccttacgttgttctctattttaaaggaaaatatttcagtcttttgtcattgagtatgatgttcactctgggtttttgtatggattttatttattttgaggtagttctcttctatttctaatttcttgagttttttttttttttaatcataaagcgctgttgaattctgtcaaatgctttttctgcatcaattgagattattacattgattgctttttttaaagtccttatgacttcggaagagaatatacttacgaattgttatttttgaattgacctgatttaactctccagtcactcaaataatggcacaaataaaaattataacaatgattatgtgcttactatgtgcatgacactgtgcaaaacaattcatgttcattatgtagttactactcaaaatacctcctaggtaggtactgctattctttccattctacagatgagaaaccagggctgagagatgttcagtaacatgtccaagccaccaggccaggaaatagtgggactgtgatttaaactctatttaactcctgtgcctgcacttgtgagagctgtgctacacgtgtggacaggacccttattctaatactgtggagtggaaaggaaggaagaaagggagggagggaaataagtataatgatcctcttttcctataacttcagagagagtaattgtccagctagcaccttcctgaaccaagggaatgctatctcgtgctcatattgaaagaaagataaaaagacaatcggtgaaggattgtaatgaagattaaaggagcctggagcacaactttggtttccctgatatttttcattacacagagttattacgtgttagagcacacacaaagtgtattctcggccaggcacagtggctcactttgggaggccaaggtgggtgaatcacctgaggtcaggagttcaagactagcctggccaacatgccgaaaccttgtttctactaaaaacacaaaaaattatctgggtgtggtggcatgcacctataatgccagctactcaggaggccaaggtaggagaatcacttgaacctaggaggcggaggttgcagtgagctgggatcgcgccactgcgctccagcctgggcgacagagcaacactccatctcaaaaacaaaaaaagtactctttttttgcagaggaagaacattataataaatgatgaaatctatgaaacagaatgaaatgggacctgcttttggaataatctaatgaaatagattattttaaataatctagtaagataaattagatttataagataaatttagaagataaatgtaaaattataagataaatttataatataaattagatttataagataaatctaataagattattttaaataatataaaataaggtcaaaatgaaggcacttctgatgttttttttcatgagcattaagcagtgcgcaccaactgaactctagtataaagtggcttaccagaattataaaaagactgcacatgttcaattttaatctatatcttatgaaaatggtaatggaagagacaatctgcctgagaaaggaatagaagaatcacattttagttttaatttctcattgataaacctcctttagaaacgagagagtattctagaatcgtccaattgatagaaaataatgtatttccccaaatgcaatgtctttgttatgaagtcacacctgcactattgaataaaatattatccatgttgtgtgtgacatgatttcagtagaataaattatcagtgaatgacccacaataaatcatatgcctccacttcatgctgttaacacttcatgctgttaatacttcatgctgttaacacttcatgctgttaattcacttctgatggggaagctactcaaattccgatggaaatgttgatgttgcagcatttgggatgagttctaatatgtttgttcacttttaaacactcctgagatgtggatgaagaagctgaccagcaggtgtgtgatacatttgtttgcgctgtgctgtactgggaggaaagaaagcagcaaaggtgtcttctctaataaacaccactctttccccttctagatctccaaatctttctaggtcttggtgcctttgagcctttcagtcaatcttttaaataaaatggtttccaggtgtttattcgtgtcaatttaattttccctaaaaatacatttctagatttttacccaaccactgtgatgccgtaaaatatggcagaattctgggcatggtaaaactgttaggaagaatcagagcaccaaccctagatgtacataatgcgtcagggtgtgaggttgagggtgttaatgacactatattgagacagtatattgagcatctgtgaggcacaggcagtcaccagatgttgtgcatatgtagcttgttagttttgccaatacctctgtgaggtactcatttttaagcccatccctaaaaatgaggaaaccgaggggcagataatttaaataattgcctaagatctctcaactaattagtaacagaatttggattcaatccaagatgatcttaactctaagcattagcatgctacaccatcacactgccagatttacctttgagattcatttgtaggttgtatgcagtgatagtatcgcctttgttcatttgcacatcaaagacttcgtgaccaatctgaacacccttgtatttgggcaccaatgtgatcataagaagaaaacgttatctgccatcatcctatttctttttcctttctattttatggtcatatttttttctccatttcaagtagagggacatccttcatattttctctctctctctctcctggttatgctgttttcattttgcaaagtgaaacacacacaactagcagaaaatgaggtgtgccaggtgcattcacacatcacttgtctcccagagtaccagactctggtgtctcagaggcgtgattctcttgaggggggaaattatgttttgcagaccttgttcatttatcacttctatctatctcagacgttcttttcttaaaagaagcaagactcaggcacactgaaggtcatttccatgggacacacttgattgcttagaaaaacaaatttgaaaaatactttcttcagaaggaaagatattgtttctccagggtaaaatatttctgagggcttgactctttccaatgacgcctttatgtaagctgttggagcagggctcttaattgataagcagctgtgttaataattcacaatgaatagcatatttaaaacgtcaacccagtgttgattcttatggcagtatctgaggcgagagagaccaaagcaacaatgacaatgaatctttagattctggaaactcaggagaagccacactatctctagagtcaccaccttccttttttaaagaaagagggaaggttcccctctccaaaggaaagtttgcttcccaggtaaccgtgatctttgtgacctattactgatttcgtttaaacagagtctttatgttcaaatgcaactgtgtggtaaaatggccccagaatccagacatctagatcatgcctgtaacacttttcttaatttttgtatttatattggataactcatgcaatttttcaaagactccattattatttctataaaatgaagataatcttacctacacggttaacctcgcagaattgttggaaagatgaaatgaggcagtcatatatggattagaaattggaacctcctaaactccaatgccaggtgttagtttctttacatctttcttgtagtcaaaaaaaattctgggtaattgttttgagcagttatattgagaacatcctctgagaaaagaactgtgtgcatcttgccatggaaaagaagtctgtctctgcacgtaaattacctgatagggcatgagagttactgcagagaggtggatgcatgggagaacgcaggggtgggggagggacccatcagttggtgccttctgttctgccccatttggggtgtgcactttaaatggctaagaaaggatatcatttctattcaggtggagggtaggggtgcttcatggaagagactgaattttaacttagtcttgaataatagatacaatttactgaaatatgtatatatgaaaatatccttcaagggaagagagtttgccaaggtcaaacaggccgagaagtctaggtgtgttgggggaaggctgagaggtgcaccttggagggagtgcaggtgtgtgtgggaggagcatagagtcttgctggacagagacctccaggggcatttgaatactgctggaaattatttggtgtgtcctggaggtaagagagaccagggagcagtttgtctgtgcaggaagcagtggagtgtggtctgcatgccctggagaagccaaggcctgagggctctccttgcgggagacgcctcctgactctcactggccacagcaaagagaggtaggtttgctggctggaagcataaacacagccctaagtgccacatctccccagagatggcgtggagttcctctgagggaggacatggctccacgccatgttttgagcacaggtgaggcagtgacttatgagggacaatgaaaggtcaattcaagctttaggaagtaggtttggacccaagaatctttttaggtgatctctgaaattatgatcatgaatgagatcatgaggaaaggctccttggatttcccactggggccattttagcggctgcccaccagatgccatgattgactatgttattctttttatttggtgccaaccagagaatcattttatccagttcagatctcccattagtagctgatatgagtttggtttagaataagaaaactaactcttagccagataggcaagcatggaatcacacatacacatacaaaatacacctttggagatagatatttgcaggtaattgttttgaaacaaaatttttccatatattttgtaaaattttaaatttctcattgtatgacattttattataacagaaaagaaccatgaattcctcttaatgaagacctttcttgtcttcactgttattatcctaaagatatttatttagcatttggtgtagtgtaagatgaattgcacagctaatttaaatgtattactggctgggcgcagtggctcacacctgtaataccagcactttgggaggctgaggagggcagatcacgaggtcaggagcttgagaccagcctggccaacatggcaaaacctcgtctctactaaaaatgcaaagattaggtgtggtggcatgcacctgtaatcccagctactcgggaggctgaggcaggagaatcactcgaacctgggaggtgtagggtgcagtgagccaaggtcatgccactgcactacagcctgggtgatagggtgagactccatctcagaaaaaacaaaaacaaaaacaaaaaaaaaacaggtattactggctgccccctttggaaacagtacaccaaatttactgtgcctgattctaagaatagaaaattgaaggatgccttagagaagaaatagagacattttaaaataatgacaactttggaaaatagcacccagaatcccgtggcttaactttgttcagtacaaccccaaattattgatttatgattttttgaccctgagaaaagatgcagatgcagagaaaagatgtagaaatccctccccttcccctctcctcctgggagccacatagggtatgaaagtggtagagatcctttctgctgagccaatagtcgtctttaaaactctgggatccccttccttacaccttatacaaaaatcaattcaagatggattaaagacttaaacgttaaacctaaaactataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcggagtgaacaggcagcctacaaaatgggagaaaattttcgcagcctactcatctgacaaagggctaatatccagaatctacaatgaactcaaacaaatttacaagaaaaaaacaaacaaccccatcaaaaattgggcaaaggacatgaacagacacttctcagaagaagacatttatgcagccaaaaaacacatgagaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccagacgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatactaataaatttaaaaaaaagaaaaaaataaaaataaaaataaaaataaaactctgggatccaaaagacagactcagtgatagtttcccaatactgttattgggaaagcaataaggctgaataaaaggaaagacccttaaataaagtagaaaagatttgcatgtgacaaaactggaagcagagaaactttaaaagcacatacattttgttcaaggaacaactatagttcttagtctcagagggatttaggcatttgcccaagattatgatgtgtaaaacagagatgctaatagctaattatcagagttatttatatgactgtgtcaggtacctgcctgaaaatgctcaacactgtccatcagtaagtaagagcaccagagaatgactgtctcttttctttgtggttctaacgtgtcacccacgttagttccctggactcagcaggtcgccaccgtgaggccccagcatttgggtccatcactggcgatgtgctgctggcctcagaatgtctgcctctgactatgcaggaggttgctgtgtgatagagtgcgggggaatcaggacaccgcccaccgctgtccaaatgccaagtggcgattcaggtaccttaggaggaaaagggacatggtgaggactggagttgcggtagatgcctcctgggtgttgaagagtccgaaggatccagaatggcagagaggggaaatgggggcagccatgcatgaagacaggctggggggcgctaatgcagctttctctcctggagcctctcatctccacctgctgcggaagctcctgtgcatccaactctgggctgggaaagcaaagagcactgggcaatcacgcctttctctgctgtctgcacgtggcgaaaatgaaagcatttcatggaacctgtttggggcacgtgaagagtgggccagagtgccagggaggcagcaatctgcaggttgcgttcatgccgtgacagtccattcaggggtgcaggagctggtagctgagttccccttcctgttttacacttctggtcttttggttctcaatacctcggggtgtaaaggacagctctttatttggctgtgaatatccaccactgtcttcctacttctctttctttggaagcatttcatttccttttctagaaaatttggagctgaagtgctcggaaggccactgattttaagctcattaaactcacattcacctttgtcttttgttgaaaaaagttaatcttgttttccaaagggccacaggaggatattgtatggatgttatttattgtccttcacaaacacaccccagagattagctcattataggttttattcaacaaagtaattattgcagagaggaagctgagcttttagtgatggacttggaagtgatgggtgaccactctcactggactccagatagaaacagaaatcaaagccgctgtctaatcacacttcactcctccctctgcataggactgtaattggtactcaaggagaacactaaatcaaagatctcataaggcaaatattagcagcatgtatcatgtaaataagaataatgatcagaagctacgcagaggagggactattgtgctcaaaagcagtggaagaaatcataaaagaaagatccataaatgttccttgaagacaacaacattagactttataaaataccacacagaaaatcagaaaagagcctagagaaaatatttaccacaaataagaaggattaccatctttgagctacgggagtgcccatatgaatcaataagaagaaaattacaaaggccaaatgcataaacagccaaggacatgaagagatgaatggaagaaagagaaaataggaatgatgaccaggtcgaccagaaacattcaacttaaccagtaatgatggaaattcaaattaaggctaaaaggagacagtttgcttataaaatcagtacctatttcaatagttgtgattcgataaaatggactcctctcaatacttggtatggctgtaattggataaaagtgttctggagaggaaatcaaccttatgttgcaagagcagtaaaaatgttgatatgctctgatacagaaattccacgtctagaaatttattctaagtaacattatgtacagacccaattacaaaaaaaaatgcaccagtatgtttatgatagcaattttttaggttgtaaaaatagaaaaagacatccattaaaaattatgcttagaataagtttagtaataataacaaatgtgttttgtgcctatgtgtgccaagcgtcatacctacataaatatgtgtgtgtacacatatacgtatgcaaatgcatatatttatatgtatgtgtacatttctatgtatgtgaattttttttcatttgatttttcaccaaccctataaagtaagacccattattatcccagtttgtagatgaagaaactatgacttggagagtttattagctcaagcaacaatcatacacccattaaattacatagcgcttcctccagatcttcaggtccagatccagtgaaaaggaaatgatactaggtggaaatccctgtggtttgtttttggataaaagtttcccaatactaggtaaagatgttcaggtttaaataatgttttgtgacgtgcatgtactggtgttttgcttgtttttccttctagctacacatgaaaataaggatattttccttgttactataaaagtattacatattcctttaggagctgctttcccccccttgtttgtcgtctcttaaaaaaagcattttctaagcagactgagaaaggagtctattaacaagcaaattgcatttgtgagtaagctgaagtgtagggagtggtatttcccactggggctctggaggctcagctccccagtgcagtggctgaacagggccaggcagtgtgaggggactggagctgggcactctgctcagggggtggacagagaagggaacctgggaaggcccccggcaggcaggactcagaggctctcaaactgctctcagatctgcaggactggcttcccacaactctgttcatcctcctccatcgcaaaatgaatatgtaaaggttttccttttacctgccaaagacattttgggaaagtaatgtgaagatttgtactttgtgaatggactcatatttatgtgtacaaaagcatgcagcagtttaaggaatcctatggtgaatactctgatacagaaggaagaattatttgaaatgcgatgcgtaacataaatgacctttcaactgaagttaacttagatactggtacattaagttttctaagaaataaatataaataaatcttatattaatgctagctaaaggcaaaccgggaggcatgctgtaaagtctatgcaaaatctggatgctcatggagaagattcttgtcaaatgtcatgtattattagtataggtagtctcacccttctaaaaaaggaaaccagaagtttgccagccaacctttaaattttgaaaaggtaagtctacagtgtgcttttcatacggttttcaaaagcagataaacattctcttttattaaacacacttctcaatttagtcatggtttgtggaccaatgttttcttaaattatttcataataattttacaacactgagaactggctgtgaaatcaacctttgggaaaaattaggagtagccgggggatgcacacacgcatgcacacacacacacacacacgcacacatgcacatgcacacgcacacgcatacacacacacacatgcacacatacatgcacacacatccacgcacaaatgcacacacacacgcacctgcacacacacgtgggtttgcatgctgacttgacatccaatgctaacagttcaaccacatttatggtttcataaatacaatgaatcatgagtagacctctaggtcaatggttctcaaagtgcagtcttcagaccagcaccatcagccttctcctggaacttcttaggcaaattctgaggacccattccagactgagtcaaaaaccctggataggtcagttattccttactacctttgcaaaacaccattctgttttagctcatggtgatcaaataaagagcaggatgaatgccaagatagagtatatagaacacctgatatggtgttctttggatcatgaccacacatctgttcccagcaaaaaggaattgtgccaacaggatgcatcaatgcactcctaatcagtgtcacctgatcatccactaatagctcaggcaaacatcagcttttccatcagtacacaaatcagtcattattcttgcctctcatcttagtgacagtacttcattgccccagcctacttgtcaaatccattgtcctgttaattttctccacacactccagggagataacagaatctctgggtagcagaccccatctcatgcctctgatatttataattgtgctgccaacctcctcttccaactagaattcctccccatgtttaaatttccaatttaatttcaagattctttgagaagattcctccaagtcttccctgttctgaaccatgtataactcttctgcagctatcatttggttcatcatggttcccttcatgaaaatcattttatgcatgtaatatcttaactgcccaaatgttattgaaaaagttttgagaggaagaactacatctcacatgcctttgtatctttcagtgcctagccactgtctcaccacaagaagttatagtgttttctttgatgcctttaatgtagatgtagattttcgctacaacgattttgccaggatgtgtttaaagatattcacccttggtcccctttctgcagttccttggatcatgaaagatgtgtttggtttggttggcccttacagttcattttccttttgaatcccaatttaaaattttggatttttaaaaaatagaaataaaacttatggctttctttaaaataaaagaagacttagaccctaagtctgcatttttataggagttgatgaaagtttatgcccctttgaggagcatgtgaattccaggctgccatggttctcagcacttcctaatataccgtgtccaatatggagattgagttctggattattacctgcctgtagtactgattttcttagattggagaggattctccatcaggactgccaggtttctagcattggctttgcaacttactagctttatctaagcaaccttgtgcaagatatttaactttgggaacagtaatgatacctaactcataatgttgttatcatgagttaataaagtccttaaaaccaacctggcacttactgagtgcgcaagaggtatttgctgttgttgtcataattattgttagaaatagtagtaatagtaggaaattcaaatgtgggaagtaattctagttggaggggaaggttggcagttgtagtaatagtatttactaatgtttcaaggtagaaaaatgaaatatgaattaggaaagttacatgttccaagaaaaatgggacacatttattttcaaaaataaagaatgttcctgtattcaatgtgtaaatacagtgttttggtctcaaggagactataacttaagatgtcagctaatgtcactgattacctgcttgatttatgttgcttcattaaattcaagttagaaaagtgggttcattcttgatttcttttatccaaatcctactatcagttttatgtggttattgtttttttaaatcttttcaatatatatttttatattggaataatgttagatttacagaaaagtttcaatgatagtacagacggttcttatttaccccttacacaatttatctcttgttattaacattttacttttctgtggcacattagtcaaaactaagaaactggcattgatacacggctattaactcaactatagactttctttggatttcaccagttttcccatgaatattttctctctgttccagaccctaatgctgagttccccattgcatttgcgtgtcctatctttccagtctcctctggtctatgacagtttctcagtcttcccctgttttttttttttctgaccttgaatcatttatttatatcaacatttttatggattgaattgtattccccccaactcaaatttatatgttaaggccgggcctggtggctgatgcctgtaatcccagcactttgggaggccgaggctggtggactatttgaggtcaggagttcaagaccagcctgaccaacatggtgaaaccacatctgtactaaaaaagtaaaaaaattagccaggtggtagtggtgcatgcctgtaatcccagctgctcggaaggctgaggcaagagaatcacttgagcctgggagggggaggttgtggtgagctgagattgcaccactacactctagtctgggtgacagagtgagaccctgccaatttatatgttaaaattcccaatacctcagaatgtgactgtatttaaagattggtcctttaaagagataattaaattaaaatgaggtcatatgaatggaccctaattccatatgactggtgtccttataggaagagattaggacacagccatgcacagagaaaagaccatgaaagtatagagggagaggccaccatctataagccaagggcagaggccgcagatgaaaagagtcctgctgacaccttcatcttggacttctagtccctagaactgtgaggaggtaaattactgttgtttaagtctccaagtctgtggaatttattatggtagccttagaaactaattcaagtatggactcatataagtcatctttgaacttttcattacaatccaattctatgttgtttatatcgtggctcaaatgattccagctttgacgtggtctccctctcatgttggttcctctgtcctcttagcatgtacctacacttgtgatttttgggcacttttctgatactacaagatgttccaggtttgttttgttttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaattaaatttggtgttttcccttagagcttgattgatttgctagattaaaaagcatttaaaatcattgtttaacacatggaaaaacatattgattgttgcagttctttataaagaaaaaagtacagtttggttccctgaaaaatacatgaattcttttagctgactcttagaaattaagacacatgtatctacaagtaggtttgggccaagaatgttccctgccccaactccgtgaaaaatttccattacatcagatacttctaggattgtatattcccttggaagatcacaaaggacatccgtctccacctttgcttaaacctaagtgatctttataaagaaaagactctttaatgtttagtagagatgtcacagaagtagacatatattagcatctttaaatgtctgctcagatttttcgtaactctcattgcattcatcctcctcttcaattgttaaaaattatagtcaattttctaaatttcaagacaggatctcactcccattgcccaggctgaagtacagtgtcgtgatcatggcacttgacctcctgggttcaggtgaccctcccacctcaccctcccaagtagctgggaccacaggcatacaccaccatgcccagctaattttttatatttttagtagagaagggatctcactatgtggccaaggctggtctcaaactcctaggtttaagcagtctgcccttcttggcctctctaagtgcggagattacaggcatgagccacagtgcttggcctcaatttttatctccctagaatatttatgattctttctgaatatcagttgcaaacccaaatctatatgataactaatcttccagaaattctaccccacaagacagagtcaactgtatacatgaagacatttatgaactctgttttcttttaggctcaacgatacttcttggcatatttttaacttttgtttataggccgttattaattttgaagtacctggtattgcttgtgtggaaataaatctgcattcgagtaattttaactctatgatttgggcgctaataatacttattgcaagagcatcctgaagtagtctcgggctaggtaattcatctagttcatcctcttcgtttcaggaaagtggatttcctagcctattcaagcagctatcacaaaataccccaagcagggtgtggcttagaaacagcagaacttgacttctcaccattctggagaccgagaagtccaagatgaaaatgtatttggtgtctgctgaggggtcactctccaacttcaatagcacctccttgtcaagtcctcgaatagtggaaggggtgagagagctctgtggggtctcttttatcagggcactcatcccattcaggagggttctgccctcatgccctcatcacctcccaaaggccccacctcctaatcttgggggttaggattttgacacgtgggaaacaaaaacatttgcccatagcaggctgctgggacagaatacagttcaggggctgcaagtccaaagccaggtgccagcaaagtcaaagtccaaaggcaaatgaacccagcagggctaatctccagcaaagcttctctgcttggcttgcagaggccagcttctggctgggtcctcacctgtcctttctgaatgcacgcactcttttggggtctcttcctcttcttttaagaacagtgccctattggatcaggcctccccacctcatttaaccttaattgccttcttagaggccccatctctaatgcaatcacaatggcagtgggggctagtgcttcagcatatgaattttggagacacaattctgtccataactgtaggtttttggttatctctggaaatggaaatgctttactttctaatttcccacaatccagagaagcaatatctttttttttcaactttagaaatcttttgaagttttgcattgttatacagcacttattcaatgccgcccaatccgagtgacttcatctcactcgacgacctcacctgactattccctggcctctgccctgcccagggcacacactgtggcaggtgagtgcttgtgcatgggcacacaaggcagatgcctgggtgttctgggcgtgctttttgcctgagatgttccatgacctggtctggtgtctcacaaagcctcctcatgagaaacacctttcttagggaaataccttgtgttgctcttttagaagattccacatgtggtccaagaggcatcagcatcccctgggagttcatgagaaatgcagctcagacccccatcccagccctcctgagggagaacctgcacttcttgagattcccccactgacctccaggcttaggaaagtgagagacacgctgccctaaagtggtcctcggtatagattcaaggcagctgcccaccccagtcatccaattccttgggctatcttaaattcttttccagtctcttctacttagtttaaataaatcaagtcacactttttctccagggactcatttccctcaaacactatatctgatgtttctgcacctactgggtttttatgcagttatgcagagatcacaggctgtttctatggatctttgcatattgcaggaatctttttgatagtgaggtaatttgtgctgaatcaaaaggctgacatgcaaagagagtatggtggcgtgtactaaaggctttatggtaatttttgttccatttcaccatcttttattcatatgccattttgatttttctagagcgaatatataggatattatctgaatccattttctcaaagctacgttttaacaacatttagtttgggacatttatttcgtattgaacacacaaaatgtttgctaaataaaggcttcaaatagcaacccctcccctgtttggtattttttcattgtttatcattggacttttagaagtgtaaataagatgtgtgagtcaaattctttctttgtaactgcttgaaaaattcagtaaccaattatttataataattggaaattaaatgagaatcaaaattcccagtgagtatatggcaagtttgttatttcctttctaccaataatgaatgataatgagtcaaataaaagcaatttgctttttcatgaaaagtagtgatgattattttaacaatcacaaaatgctttcctgaacatgttcttttatcatttctgtagtattgaactttaaaaaaagatatcattgagaataagtgaagcatggaacctgtaaattgcctgtttttgaagccatcgtgtccatcatttttagtgagagaataatgttctgatatctccacttgacatcttagactctattgtgttataacttcccacaacttgccaaagggccattctaaacttttgctcttcaatcggccatcattacgggaatattggcttccaatttttgtgtactaatatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccatttcctaatggagtaaacagatatcgcactgcaagttacaattttcaacatcgtttaccctacacctccaccattcggagaggcagctctaataaatgagatgcagtgatgacctttaccggctccaccgatagctataaattgagctgaacattcccatcagctaacaggacagaactcattactgactgaagattgctacgatgcctttgactgagatgtgtaccattaaaatgaatgctccttcactcgtaaaaacaatgtcttgtaccgcagaagacctgatatgccattcattgatttttgtggatgactacaagaacaacccgtaaagattagctgagtcttactgtgtgttagttaaattatgattcagatcaatttgttcttttttgagagagttgattttttgtttcttaaattagaacctttgtcgatggcatgcatggaatataattgtcagatttacagtcctgatgattcaagcttagataaacacttgttccaaatacattaaagtaaaacttatatccattaaactaagtcaggattttgaatttttaaagctttgggtacatagaaaaaatttggttttgccgatttttttggcaaaatgactctgactttgagaacaaaccagtgtccatgcccaggtgacagcacttgccctgctgtgattattaaagcagccccttgcactgccaagtgtcctagtccagatgatgaattgcacagtcttattggaagtatgtgaaatgggaggactgtagccatacttgatctctaggatacacttttatcaggccctacaggtaaagtattcccataggccttgtggattttcacaggaaggcctaagttactcagatgtctgggagttgtccctggttggtttctgctaataacattagtagtcctgacgcttcatacttagcaggacctaataggtgaacccagatatggttctaatgtcatttaagttattaattgacattattaatatccccattttttttcagatgggagtatcaaggcacagaaaagccatataacctgtctgaggttccacagttaatagctagtaagcatgggaatttcctaggactccaggttagggaactacatcagacacgggttctcatttcaccaggaaacaaatgcgaggacattcttacttccacttactacaatatattaatgactagtgtgtgatgatacctccacccactcggagcttagagtgataacccggttatcctgcagctttcagatgatgggttctacctctctaattgactagactttctctaataatactggcaaagtctttatgggtcaaagtcagaagggaaagagtctctagtcagagccagagtcataagacacagtgaatgtatactaatgatgccacttggtaaacttccagcatgttatgctggaggaggctgggaggcagtctgtccctctgtccctctgtccttggtggcacagacagccccctggagccagccaaattcagactcacattctgcctaaggcagagggacacaggcagacacacgctaccaggagacgtctgcctttgacatcccacgtttgtgacacatgccagatcttctcagaaagaaacagtgcaccacagccactgtgccatcaggcactttgacactcacagacataaatgggcaagtcggaaggagtagatgattccctctaagaggacctgcctacttttcctgggagagtgaagaaacctctaatcattggtttctctgtttttccaacccaatgagtagacagaattgttccatgtaatgatttttcttctctctgtataagacactggccttcctgctgtttgcattttggattattttgtttgcttttaagtcagaaggacaagagttgtgtatagacaagctttatcatagattctacctaaaattcttctggaatatgattcagttttttcctttgtaaataaaatcataggtgaatgtgtggtcaaaaggtgtagttggttttcccctttcagagatctgagtgccgctgggggaggtggcatctcatatttataaaacatgttatttattttcttactttcaaaatgctaaacatagctgatctcaattaatcagcacagtaaccctttcagaaaaataaggtattctattactgaaaatgaaagactgcaaggtaaagtaactgctctcaaaaaacgctgcaatgggattagaaccaaattctcctgattccaaagccagaagttacagtcagagtatgattgtatttctttattaagattaaagtcagctctcagcagcagaaagattaaaataatactagtttaagaaagatggaaatttacttgtctctcaaatttatttattttccacatataagtccagaggtggaatctacactgtattttgcttttatcttccattttcatcttttgcttttatcttccaagatcacctaaaggaacaaaatggctgctctagctccagccatcataaaagccttcctgctagcagatatgaaagaggagaggggactatcatgctctatccctttcaggactctgctttagaggttgcactgcatacttctggcatagccagtctgtggcaaagcctaaaatagaggccaaatttccagatttttggaccaagctctttccaacaatctgtcccttacgcctggagctttttgtcaccgttgtgttgatgtaatctttggtcaagtttctgtctctcagcctatccattagtctttgctagtaggaggtgatttttctcagggatgcatagataaggtaaggtggaggcttggctccattggaaatgctgaaatgaatttactgcaaaactagtgttttctatgggagtgggatggggcaggaaaatctattgcatctccaccagccagaattcacttgcgtctagtaagacctcctcacatttccatcagtgtctacaacttacagagtcacaaaaagctcggagacaataggaacagacatcaaaattatcagtaacgcaaaatataagtgcccatataatgcctaatataagtagcatgtaccggacaatgcctcgtattctactgaagaaatagccagtgatcttctggcggcccatttcaaagtcttaaatttttttgacaccttcagtaatacttgttattgatttgctctaagtgaggttttttaaataatagaatcatcataatccctttagagatccttcaaaaaatcttagatttatataacagctaatcataagaatccttaacaatgtgtatatgcgaagtccttttgttcgttatcaggaaagggcttggctgataacacatttctgaggatattcattcctggataaatttttaaggatttttattctttgctgatctttatttcaccttcacccctctcaacatttgaaagcctacttaactctatattttcttttatgttaggttcaagtgaaaaaataatttgcaaaaacaaatcctaattctacaaataaattgtttttttttttttccttaaccatgtagcaggtggttgacaatattaaatacagaaagagggccttcgttgtttcagtggggtttcagtgtatcaagctgtttaaaagtctaaacaggactctgttaaggcacataaaaattgaatagaaaataatggaaatgtaaaagattttaaaagctatttgggcaatgcattaatcaaaggcaaattgggcagtctcagatcttatgattaaaaattaagtgaaattgaaagccactaaagtcatctttgaaatgtagctacttcccaaataatttccaagctgtgattatttttttgaaagtacgaaagtacttatcaatgtcattactgacgttgtaaaaatagatattgtggtatcattttaccgtagtttgaagtccacagaatgtaataaccctcctctcagtctatccacacacgcttacccatttcagccccagacaattctccacctttgtttccaaggtttagggtttctaaagcaaatgcctcctaataacctcagacttacaaaatacagtacctggttgcattcttgaaagggggaagaaaaatattacgtggtctttctaactcttttttttttctttgagacggagtcttgctctgtcccgcaggctggagtgcagtggcgcgatctcggctactgcaagctccacctcccgggttcacgccactctcctgtttcagcttcccgggtagctgggactacaggcacctgccaccacgcccggctaatttttgttgttgttgttgtatgtttagtagagacggggtttcaccgcgttagccaggatgatctcaatctcctgatctcatgatccgcccgcctgggcctcccaaaatgctaggattacaagcgtgagccaccacgcctggcctcattcttattctcaagatcctgcaggaaaatcaggtgtagtgaacctcccagtcaggttatcccgccacgtatgttaaagttgccagcgtaagttggaatcaagaggcctgcgtgaggcccttgagccagagggagctcattaaccagccagcaattctaatgttcacatctcacttagggtcttggagaagctgggaaatctccaggtctcgggagcacgtctcacaaatgtcaaggctgtaccaccttggttaagcgcttactggcagggccgctgaatgctgtttgtatttagaatggaaagaaatattactagaaaacttgctcttttgaaagaaacctttgtacctctttggagcccacattgccttcctctgacaatttttgtgaggtaaaccagaaagcagaaaacccagacacgagaaaaaaaaattggaactctgtctcctccctccaggcctaatcctacgtactaaactgcagccccgctgtagagcttcccagcgtctgctcaggagccccctgaactgtcttcacctgtacaattagtgggtgttatgggaacgtgcacctctggcttcccaccttcggtatctcccacttcctgtacttgttttacctaaacacgagaatagttgctcacagtttagtctttctcaattctaccctcacccaacgttcccccaaaacccacctctggggcggggatcgccttcctgatcatccagggagaagcatctaggctgttttgagtcactgctcctcactgaccgagtcattcccaagtggtgcctgcactgtggacaagagctccaaccctattgtacgtttctagaaatcagggattatgtggtcttattttctgctccattttttatgaaatattttaaatattttcttgaaagggggaaggaagacattactgtggtctttctaactcgttcttttcttttttttgagacggagtcttaccctatactgtactctacagaaaagtagaaaacatatttcagtgaacacctatattaccagtacaaatgccaattaatttcaatgccttggccatttttgtgtcctccatcagttctttttttgctgaaaatatgtaaacataaattatactctcattttctttcatccctgaatactaaaacatgcatctccaaagtgtatcttcccatacatccacaggaacatcattgtatctgacaaaaacgaccataatccccaaatatcattacattcccaggccatattcaaattcccttattcagtctcaaaatattttctgtagcttttgttttctttaagcctggatcaaattaaaaatcataattgtacttgattatgtcttttacatttctcttaatggtagaatggctcctcttttttctgtgatatatgctatttcacaatacacctggattaggccagttgtattgtaggccctcctgcattccgcacttgactgattgctttcttgtgaggtggtttcacaggtttatctataatgtctacttgtcccatgattggtgattcgaaggggagattaatgggcaaaagaggtgaccaccaaatttctctattataaacatgtttttcccattgagaatggcgtattttctgtgggataatatcccattaacttttctccaaatgaggttagcatccatcattgatccttacctgcaccaagttttacgacaggggctacaaagcggtgatgttctgaattaatcacctcttctacacttacgagttgacagtcttctgaaaggtggaactctccttcataaacaggctatttggtgtacctgaagtaccaacaaagcaggcagctgaatccttgtctgtttttaattattagttttcagattaagaagttgatatcatagttatgttcagctatggaaaataaatagttttgttttctttaatgttttgtgagtatcactattgacttgtgctttctaaaatgtattcactgtgtcttcatcaccgatagcattattcttttggtgtttggattgtcctaactttgaccatggagagcccctccagagggttattctgtccttgtgtcagttatctaatgccacagagtgctgtgtaataaacaactaacaaccttccagaacacatagaataagtcatttttcacaaacctggctgttggcaggtggtggttagggaactccacgtatctcatggctgatgtgctcacatggccagacacccagctggatgttggctgatctggagtggcctcttcttggatgactggagcaactcggtttgttcttcatgcctttgatccttctcctgggccaggacactagaccaggcatgtttgtctcatggcaatagcagaacccaagagaaagcaagtccactgtgtaagagctttttaagcaccagcccgcttctacttactgatattccattgcccaattctagtcctgtgtctgagcctagagtcatgagaaaaggcccggaaaaattagatggaaaagggtggggtgaagaattggagccatttacaatctaccatggtcttattgatgtgtccttatcagtcacttgtctcccccactggtctttgctttctggccagtaagatattttagatttataatatactttgtgtgcctcagacctggaaacatccattttttcaaggatccctggctcattttggggagaatggtactcagagacaaaaatctgggtgtctaggataatcatgcttctagcccgttttcatggacaaaactagcaagtgtgtagttttgaacaataaagaaacattggttcctattgatatttctgatgcaaattcaacatcacagagttttaaattttaactgaatttccttttgtttgttaaagacagggtctcactctgttacccaagctggagtgcggtggcacaatcatagctcattgcagcctcaaactcctgagctcaagaaatccttccacttcagcctcttgagtatctgggactacaggcaaataccaccatacccagctaacttttaaattattttttttgaagagacggagtctggctatgttgcccatctaatttttcaggctctcaaactcctgggctcaagctattctcctaccttggcctcccaaagtgctgggatgataggcatgaaccactgcacctggtctgaatgtccatgattaaaaatgtgggtctcttttctcttgtacagaaaatcttagctcctaataacattaacggaattgtttattttcttggaatgatgtctgagagcacaatgctgtgattaacacggaatgctaccacagctaatatgcagtaactgtcatatgattatcagtttcattaaagtcagagaacgtggctaacacatggtccataccaaatatctagcagagcatcccgtacattgtaaatattttttaatgcataaaatgtctattggttttgttgttttgttgtgtttttttttttgagttttgcttcttgtacctatcatttctctttttggaaacacctaccttttctaagcatattctcatgcaaatgagttactgatctactttaagcagaatgcacataatttcttttacatttcctcaccgtctctatgtgtagtatttccttgatatgctaaagggctgtgtgcagttctcataatcccaaagaaaaggatgtagttatcatgttgcgtactttttaaaaatatcatgagttttaacaaaacctaaaaaccagaagaggctttggcatttccatggcattcaaactcctactttttaatccattgattctgatgacgattactgaggctcctgctacaatataagcctgcattcttttttaaggtcttgtgacatttgggttatgctggaatttgtttttaactatttaaagatttcctattttgtcccacagtggttgtcttctttatctttaagataatatctttaacactgaagacattattggcaagaggaaggtctggaggtctgctcaccacctttggtgttctcttccatagccatggcctgagaagggtgatttttccaggtgaaagataggctgtggtgtaaactaagacattccaaatgaaacataatcacttaatataacctcgtagatagtgctgtccaaaagaactttctacagtattggaaatattctatacccacagcatccaacacagtacccaccagctatatgtggttactgagaacttgaaatgtgtctagtataaatgaggagctaaatttttaatgttatttaattttaattaattttaatattaatggaaacatgtggctagaggctacatattagcagtacagttctagattataaatatggtccaactaaaatatttgcatttgactcatgtttcctgaaagaaactggcagtaggaattaatgtcagctttctaatcatttttgattcttcttataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttaccaaaagatgtaaagaagaatattcatggtagaatggtttgtaataacaataaaactaggaatgactggtatccattgtaatatacactagaatcgtgtacatcagtgagaactaagagccaagacagcatggactattatattcacctcagaaatatgatataatataaattactgaggaacacagtaaatatcaccttattaaggtcaaatgcaaaaaaaaactaaacaacatagtatttaaagatacataaatatgtgataaaactgttaaaagtaccggaatgataaaattcaggaggaaaaaaaagtaatcatacgttctaattctgaaatggtctcattggtttccgtagaaacaagcaggttttatgtacctcaaatgtagtacggcataatcttttttatgtatttatttattttattaagttccgggatacatgtgcaggatgtgcaggtttgtagcataggtaaatgtgtaccatggtggtttgctgcacctatcaacccatcacctaggtattaagccctgcatgcattagctatttatcctgatgctctccctcctcctgacccctgcaacaggccccagtgtatgtcgttcccctctctgtgttttcattgttcagctccccactgcatactcttaaacaatcattatgtttcatggtgatcagtaatgtgggggcggggtagaagcagagaacttggaactcgtgagggggtgtcaaaggtagtaaatcttcatccattgaaggcaaacttgatatttagaaattcattcagagtaaaagctaatggacgaagggagataaggtgacaatcaaattaagtagtaaccttttttgcaacttatataactaacaaacttaagtgctttctaaaaaaaaattctaaaatttgctatataagggcaacttcactgaaatgattgcagagtcttccatgtgagttcttttaatgtgagatagctcattcaatagatgcaccttggtgtgtttgcttaagaaacagaaaaatatgactcatttgatttgttcatgaaagtattaccaggaaaataaatgaaaacaatttcacctaaacatctgttaactttagcactgaagctttggatgtaatttacataatgcataaagtagattgatctaggaccatgtcgatgatgaaattttcattatattgatagactttcattttcctcataaaatctacacatacttaaattataacaactctgcttttgaattaatccagtctgcataatgtttttcagtcatcaactattatagtgtgaaatgcctttaccatcaaactggctcaaggttactgccttcactcagaaagatagtgttttccttctccccactgtgggccctgcctctcaacctgcaaccctacatttcagaaagtagtttgcctgtatgaaattttcttactctcttctaaggtagtggctgcaaaatggtacctatctctgattttaatttgcatcatcagagtgttaatgactttaagagtctactcatgtgcttacttactatttttgttttataaaatttcttggtgtacgcatgttctcactcataggtgggaattgaacaatgagaacacttggacacaggaaggggaacatcacacaccagggcctgttgtacggtggggggcagggggagggatagcattaggagaaatacctaatgtaaatgatgagttaatgggtgcagcacaccaacatggcacatgtatacatatgtaacaaacctgcatgttgtgcacatgtaccctagaacttaaagtataatacaaaaaagaaaaaaaaaaggcataaaaattctagaagaaaacattggaaagtgtctttatcatcttggagggtcaaagatctttctaattatggttcaaaactaagatgtcgttaaagatggatacatttgatgaaataaacatttttttaaattaaaaaaaattattggtgtatttattttgcctatttttttctgttggagtgtttttatctcattgattttggggagttgttttttatacaaccctacctttcagaaatacaccctttcattcataggagatatatatgtacatgtccatatgcataccattttgagtaagcgtttttactaattttctaaggggatgcttgaaatcttggttgttcatctacaagaggccagactcagcatctatgagatgtatagattcaaaggtattcatggcagcgaagagctaattcctccaagcaagagcacctaggggagctcgtggagcagatgaaagcatgttttgcaggatgtggctatgggccacaagcattctgcatacagatttactccaaagttggatataggaaattagtccctttactaacagttgtctttggctccttggagtatctgctttcttaatctgctctttgtgtcctgcccaagaacattctagctgttccaaaggttttcggtgtgtgcgcctgtgctttctatgtcaatgtgtaaagtaggagagaagcatcatgtgaggctggattaagaagagctgggcatattgcaccatattgaaagggccgtttgatgagtgggagcctatctttttttcagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcatagccaaggagaagcaataaacttgtaatactacaggctgagcaaccaaagataatgtgaaattgaaaccacgctaattcaataagatgaaagcactgtttctttcattgtctgggaaatttctctgcaggtgttgggaacaagtgttgcatatcatatataattaaaagataaagtcctaaggcttttacacatttacagaacaattgcaataatgcatgtagaatacttcaggagaatttgctcaatcctgtttaaaaaaagctcgtctccgcatgcataggaagtattaacttaggcactgtgactgtacttaccctaattatattaagtggatgcttatgcctcaaagtaaatactgagtcaatatgaatgccactgctttatgatttgggaaaacttgttttcccaaatatatgtatattttttgagacaggatctcactctgttgcccaggctggagcgaagtggtgcaatcatggctcatttgcagccttgacctcccaagctcaggcaatcctcccacctcagcctcctgagtagctgggactacaggcgtgtgccgccgtgcccagctaattgtttttgtttttgtttgtagagatagggtctcactatgttgcccaggctggtcttgaactcctgtactcaagcaatcctcctgctttggcctcccaaagtgccgggattacaggcctgagccactgtactcgaccccaaagatttaaatggcattaagatttgatgttcatgtacggttaaagatatgtattagaaatattgactggagttatacaccaaaatcaatttaaagagaattaacattttgtttgtttacaaaatgttcagactcttattagaataaataaatctccaactcaaagcagttgattcttttcttgtttgagacactggggaaatcaaaggacagaactaaggttaaagctatgttaaaaagcaagaattgaaacaggctgtgaatcccgttaaagcgatcataacagggctctggtatgaatcagaaacacagaaatcctagaatcctataatccgggattagaggaggttgtaaaaaaaattaaccggttccctggttttacagataaggatcctgagcgagacttagagcatgagcttttgagtctcacagctcagtgatggctgagggagcattcaggtggtgtcccagaagcctgtgtcccagggagaaggaaggatggcttcatctttaccctaccccatccccagatccacagaaatgctgtgctgccttcttttccctcctaaagaacatgtaacttgctatttaaatactttcatttcttttcttttgcataaagatacctttttattaaaaggtttgctgagatttagtattaaatgcatgctgcccctaacatagactgcaggcgtaagggaggcctcacgctgttggatgatggcatagttccaaaaatgatcactttattgaattaaatagtattctgcaaagtaggacctaggacaaatgaatgtgcctgcatttttgcattaaaaaaatcatctttggtagaattactcccctaagagaatctgattcaactcacttagaaatactaacgttgtagaaatggttttctaatattaatagagaggataaaatgatcagactgttgctgagcgtcagtgcattttaatgtcggaatgttatcattatttcctgtgaggatgtcagtttagtaaaggctgggtgttgtacataacagcagcacttagcaatgaaatacatgaatgtgaaccgccttctctttctaaaatcaatagcttgtgacagatcatatattttaactgaagttattttagccaagtcgcctttaataaggtgacttcagaaaccaccatgggtaaagaaaagttctcatctcagaaattcgctggcttattctatataatgcaatcttttttccttaaaatgtcacttttccatccattttataaacatttattaagcaccaaatatgtacagcctaatggattcattattcctttctcaaagctacatttaaatgctcctgtcaacagactcaaaataaagaagacaaaaaatgtcatttagaggtctgcatcctaatttaatttaatctggatttaatttccgcagagccacttagtcatttaaaattatcatgcctcaattgctctatctccaaattaaagctgatttcttctgccagcccagaacctgggtactctgtgagatccagcaatggaatatgtgtatgctctgtgtgttttcatgagcaagtatggagaaggtgaagcctggtgttccacaggggctggaggttggaggatcacccacagcctggaggaattgggaatggggagcagtagctcttccatattctgttctcttgccttcctggtgactgatcaggtgttctcttctcatttgaattccagaagctgtgagcttgtataaatgataaaaagcaatctgaggccaactgtaatttttaagttgggctataaaacagccttaaacaagttgagaaatggaaaggaattggtaaattctgtggtcagcagaattttaaaatattccctacaaccttgacctctaataacctcattctctttcccgagccaataaaaacagaccctcctcatagctggtcactgcaaggtaccaaagcctgtttgcctccagcttcttctttgctcctgcgcttactgtgattggctcttacatgggacaggtggatggaagggcctgcaaatcactgcaaacattttgtcaatccagcaggaaagcttttaagatagctggtgattaagcaaattcagagcttgtgctaagttctgtatttacatggatgtatttcacctttccttcccccaaacaatttcttttgactaaatttactaattcagtcatcctttattgtgcttttaaatggtagaaatcatgaaatatttcacaataccacaaacactttagattgttgagttcagaccaggtgcggtggttcatgcctgtaattccagcactttgagaggccaaggcgggtggatcacttgaagtcaggagttcgagaccagcatggccaatgtggtgaaaccccatctctactaaaaattaaaaagttagccgagcatggtggagcatgcctgtaatcccacctacttgggaagccgaggcaagagaaacgcttgaacctgagagttggaggttgcagtgagtcgacatcgttccactacacgccagcctgggcaacagagtgagactccatctcaaaaaaaaaaaaaaaaaaaagagtttctgtatgtgtaaacatttaaaattctatgatgattatattatggttcacaatttggggggcattcttttgttttatatatatatataaaacaaatatatatacacacaaatatatgtattttatatatatattttatatatatatatatagtgggctatttcctgatccttattatttgatagcatatcatatttgatggtagctaagaactgctttttagaaaacatttatcaaaatgtcttgatccatttcctcttttgagaatttttgaagtgcttgtctacatttctacagaaaatgaatcaaataaaagcacagttgtccccaaagcacaagtgcatcatctctgaagtagctctcctcagctgtaaaggctgctgcccagttctaagctcactggagcaggttctgtttgggatttaattttgtctcccacatagtgctcagcaccatgacctgcacatagtagatgctccactgctatgtgttttatgaatgaccgctctagaataacaaaacaatagagttgagcagttttccagaaacatccatgtgagtgacaggtgtggaggggcattcagcactggggtcatgactttgagcttcaggtctaccttccagccttggcattgtgctctgctcaggaacaacaggaccccagccggttgtgcaagttctgaatgtccagtcttatccctcaggagtgtcgtaggactgaattacagttgtaacagctggaatgtgggtatatgccacatgtggattccagagcgttaggctagaccaaagagcctgggccaggctcagggctcaggcaggaggagtgggttggttctatgaaggaagagacagaggatgatgatgtccaaaggagcatgacaaggatgctgccgcatgtgggcggctgcgtgggtccaggcagcagtagcagacagtggaatccacgccactttagttttgaggtccatccctcatgaagctggatgtagcctgcatcccagagtgaggcagaggcatccagagctggtaattacagcaagaggcactcgcagaactctaaacatcaataaaaaatcaaacctaagctcacttttatttgaattacatgtttgatgtcacagaaattccgggaccttacactttactcttttaaacacaattttaaatgtcaatgttattttacgtttcatgctccttataagactcttgtcaacaagatagcacatcttatcaaatggcctttgttctattatgtatcttgtttttttttcctaaaaaatgaaccaccacaaatatatctcatggtccaaaattggatctttggacatttggccaatggttgcctggttcctaaagtcctcatgaatttttatcttctgagtagaacactcctttttcctttccctccctccctccttttcttcatccttcactcctccctccctccctcccttccttccttccttccttccttccatccttccttccttccttccttccttccttgtagaaatacacttaaaatagccttaatacattttgctgaactaaatagatttcttggggacttaattcttacaaaaatttaacaccatctctccaattcttttaaaacataatagagcaaaaattatcagaagggtgaagtgtttcaccagtgcttaatatttagatatttaaagctgaaatagtctttagagactgtgtctttcaaactcttcttttatgaggtgaggaaactaagaatttctaagaacagttctctggcttaacctccactgatagtgctatggatgtaacgcaccagttcagaatgagtcactgtattgacctgtgtcactcatactgtataggccctttttattgacaatgctatcagtgacaagaagcattaagatttatatagtcattcattgtatcacttaaattctgccaggtgtttggaaagcaacttagtgatacgtttcaggagcagtaacaatattgatgcatttttatttgctctggggaatgcttctgtacaaagttgcagcattatttgttaatacaatagtgaaaatacttgaaactaggaaaatgagataactttttaaaaaaagataaaatatgatgtattcattaaaataatagctatgaagggtatgtagcgatacaaaaaatatttatgatatattttaaaaagatacaatatactaggctaacaactatatatattgaaaggctagaaagtgaacactgaactatgaaaatacttaatcttgttgggtggtgagattttgtgtattattttctagtgtggtgatttccataactgccatttcaatgccatttattcaataattttaatcgggatttaaaaattttggtttcatctttcaaaaaacagcagactgccttctcacaatgagtatgtaagagctgtagacagttcccggaaattcttgaaggagaaaataagtcgattatttaaaaaaaaaaaaaaaagtattctattgttatgcttatgtcaggctttctccatttttatgtcttgttttaattactaatttctttgttttaattgcttattttaatgactaaattaacatctaaatgaaatgtattttctctaagctgtatccttcttggttttatataatcatagatgtagaatttgaatttttatctctgtctctaaaaattaattaattctgactcctcacagaaagagacataaataggcaagtattattagacccattccaaaataagaagaacaaataataggcctgtttgtactaccagaggaactccagaatgtggctgagattagaactcgagactactttctttttacttcttcaaataaactccactggatacttgacccctgcatcagtaattctcactttattctatgtcatttaatttctgttaagtgctttatgcgctagtcctctcagccctgaaacagggtaaatttggaaggaaacagaagcccactttcttacctctttctcttttctgttctgcacagagcccagtgcactgttgaatgggaagcacaggatgttctgacaggtgtcatctcagccaggaacaggctggcccccgggaagtgggctcagcctcggtttcagctcctgttgtcctgagttcactgaccactgataaccaggacggtggctgcaacttcagtgggccagcaatggcccatgagccatctctaatctgaggctggatttcacttagcatgtcagtgaaaaccatgaggggaaacagccgtgtttttgtgtacggttgagagggcataaactggcagctcgtgatgcccactgaaatgttttgtttggcccacagagtggtttttacaaactaacccagatttctggcgtctcttgaaaaatacaaagatctggcagcagcaagatcctcatttgctcacagagagcaaaatttggctggagctaagaggcagctggcccctcagacaggacatgggccgaccagccctgcagtgacccacatttgctgacttctaaccagactggtctctgagtttgaaaccccttttagttcaggaacaaaagggtggcataagaactcaatgtcttctgcaagaacgttgcacattgtgagaaatcgtagcacaaactgtcttggtattatctgtattcatttctgtctgtaaaattccctggatcctctttgtccccctatgtcattatttcatttttctcctgtgtctcagagggtctctctctctctttttttttcttttgtctttcttgtcctacttttctctctcctgccttttctgtttctacttctcttactacaagatagaacagaaaacaagtatattttacttacttttattctaacttttaccacatagaccatgattttactttttaaagtggatgaggctgagcacagtggctcacgcgtgtaatcccagcactttgggaggccgaggcgggcagatcacttgaggtcaggagttcaagaccagcctggccaacatggtgaaaccccatctctactaaaaataaaaaaattagtgtggcgtggtggcaggcgcctgtaatcccagctactcaggaggctgaggcaggagaattgcgtgaaccggggaggtggaggctgcagtgagcagagaacacgccactgtactccagcctgggcaacagagagaaactccatctcaaagtaaaataaaaataataaataagtacagtagatgagtatttatacttatgtctttaaaatatctgaaaagaggccgggcgcagtggctcacgcctgtaatcccagcactttgggaggctgaggtgggcggatcacaaggtttaggagcttgaaaccagcctggccaatatggtgacaccccatctctatgcctgtagtcccagctactcgggaggctgaggcagacgaatcgcttgaacccaggaggcagagggtacagtgagccgagatggtgccattgcactccagcctgggtgacagcgagactccatctcaaaaaaaaaaaaaaaaaaattctgaaaagcagtacagtagtggtttaatctttctggccccagagctactgttccctgcaggctaagggctgtgtaccatcactcctccatcacacgtatactcttcaagtgacagtcagggaaggccttctctgtgcaaggccctgactagacatggtggtgggtggatacagtgattaataaaaacagatttctactcttatgtagctttcagcctgcatataaaagaagtagttgttttaacataatatattttgcaacggaggtattaatccaatgtgcaatgagaacaaggtgagaaagaaagaggattgctgggaactctagatagaggcttgcagaaggaacatttcagcagtccttgaacatgggagaaaagtcggaaatggcataataggcaaaatgaaaagggtggataattccacatttcaggggtagacagtgcggttagtaggttgttttgggaggggcttgaaaagttgtggctggaaggtctggggaaaaggtggagagaggtcttcaggaagcttccattgtgtgtagtctttagtctgtagcacatggaaaggtgtcaaccaaaattaaagctactgaagcagaaatgatgtaataaaggtttattggaagccacaggtgagaatcgatctgggaaaacacaccaacaaagttggacatgttccagaatctgttacaagccagaaggctttcataagaaagtttaggagaagtgaaggggactcctcatatcagagttgtcctttatcattaagaggtacaataaaaaggttccaatcactgacaacagattgcaacacacaggctaaaatgcctacgtgcaagacaatcagtaaaacttcatgattcagaggcaaatcagcatccttttcaatgtcagtagatcacacagtaatcagtacgtcaacaatttgaagagctcacagtaagattgtttacttagcgacaagatgacacacaagacttcttccccaggtgacttaatttggaagtttgccaaatgtgacctgtagggtattatttccctcttttgattaaaaaaacaacaacaactaaccatggaagcattgatgatcagtctctgcttacgttagaagggtagacatccttctttccttccttggctctgcgaaggctcattcccaagaagtcatgtccctgagtggggagaacaaaccttatcatcgcatgtgggccaggttgctagcaacatggggtagatcatgacacgaggttacatgccaatctcctgaataatgaatcaacctccagtctctggacgatcattattttggccttaactgtggaggcatagtttacaaattctggagaattcaggtacagagaaaggtaaatgttttaattttattcacaaaagtatactttacctgattgttttaaaatacaaatagctcctttatttataatttttagaaatatgttttgctatagtattgttattttatttggaaataaagaatgagtattatttaaattgaacataactttaagattgaaaattatgtaacaattatttataaaagtttatcccatttatatttacctaatttatttatttttaacagtttacctggattgctcatgaaaactgagatattggacaaagttagtcattatttcaagttacttccttgttaaccatttttatggcctgtgaatatcagatgttcacttaaggaaggagtttaggttaaatatatgggtattttgctaataactcagaagatacagctttttttcatttaaccaacaagattaaattagtcttacccttcaaaaaattacacaaaaatcattctggttttggctgggcttgtagttctataacctttgtgccaaaccctgacatttaaaaatatctagcagagacaaatataaaattgtcttccaagtataatgaggcaaaagggtatgctgacaatcttgaagacatttctacttttattttatcaataatttaaaaaccagcttgtttattaagggtttacttaagtcatgtgaacttgggaaatatttgtgtttactaatttatgaatgctcatttatttatgttgatttggtaccaggtagacataacatataatacatctaagtaagtgtaaacacatctaaacatacacaaacacaaataaagattgtacagctttcattttagaattttagttctttttttttttttttttttgagacgaagttttgctcttgttgcccaagctggagtgcaatggcgcgatctcggctcactgcaacctccgtctcccaggttcaagcgattcactggcctcagcctcctaaatagctgggattacaggcgagtgccaccatgcccggctaattttttgtatttttagtagagacagggtttcaccatacaaactcaccaatttataaaagacagctggatccaagttatatttctgacaaaattgggacctattcatatggctaaactttttttgcccctatgggtaatctaatgaaagctacagaccaaaagtttgggtaaagcagtttccatgtaagtttgatttttacaaacttcttttaccattttttataagtttcaaatgagttcaattttcaatgtttacattttacctgaaaactgaccaaattgcataacaaagacaaaatctccaagtagtcttgaaatagtaacaaatctatcttttgtttgctgatcttgtttgattagcaaatgcaggtggggaaaaatttttagcagtttctctcttttttgggggaggtggcactttttcctttcagcctttgtagcagaaaaagcaaaatttttgtgctagacacagatagatgattgctctgagctcaagattctgacttattagacctgagggcctaacttttctaaacatttatctttttcttttagattattaattgttcaattaagcatttcattttaatacgagtggctgaatctattttaccaatgccagtggaagatcgggatcataaatggtctggcaaagcttacaataaatcaattggtatcattcattagtttcagtttagaaaaaaacttgttggatctgtatttttatcatctcagtaatttcattctcatgctgtagtcctttcatttgctccttttgttccaaattcatacatttccctcttttgagagagaaggaaatgtgtgcattgtgaaattccaaaaatctctgcctaagaaatgtatgggagctgagggaacaagcagagaaggatgaggaatgaggagcagttggaggtgaaagggacaaagtctctgaagtctttttcacggcagagatagttgcgaatatccttttgtttacctcttgaatggaggcaattttttctttcaaaattttttatggaagcttctaggtgctattggaagtaagtcttccattcaatttgtctaattctaaatccagctttttccaattgtgtgcccaagtaaatcattttaggcatttcaaagggtccccattttgggtgttgctgcttatgaccatgccaagttaggtggatccacttatctaagcacttgcaggtaaaaggaccaaaagtattgtgcataaaaccagctggtgttgattagaggcagtgcactgtcagtctcagaagacctgctttccatcgtgattgttttgagtgagaccagctatgtagtggagcaaaagtgcccctcatgccatcactaaggaaaagtgctttcgccccaaacctccagggaaaaattcacagagctactttaccttgccctaaaattcaaacaaaaacccttaccttggattggtaagagggatactcgttctgagaaagacattgtattttctagccaaggagaaagccagcttcaaaaaaatcacaactttgaccaagacgggaagtttgttgatttcaggaagaactcatctgtaccacccagcaggggcgtccaagctcacaatgggtttgttgccaggatctgcatgaaggctggaagctgtgctggatggtccatggaggtcactccaaagcctactggctacaccataatgttgacagaaattaaggctgaaataacgtgataaaaggtgtattggaagccaaatgtgaggatcagcccaggaagacacatcaacaaagtcaggagtgttctagagtctttaacaagttggaaggcttttataagaaagcttaagagaagggaggggactcctcatatctgagttgtccttttcattggagggtatgatacagggcttataatcattggctacggattgcaacatacaggctgaaatgtctgtatgcaagaaaattagtaaaacttcttgattcagaaacagatcagcattttttcaatgtcagtaagtcatacaaataatcagccacatcaacaatttgaggaactcaaggtaagatactttactcagggacaagatgtcaccatgcatcacaagaccttcccccaggtgggttagaatttttgagctggttagaatttaaagccaccgtgctttaggaaaataactgtaaccaataagaaaggggtttgtagaaggtaaagattataaacaaaacatcgacagtggctgcttcaagtccaggtgaatgtgatggaggtcttaaattaaggcagtggctttgaagacacaggagaagttggtttaagttacatcacaggagtagaattgataacacttggcttcactttgtgtacaggcagatgggattaaacaatagtctatgttgtctggggtttttcgagacttgctcatgggtggagagatgtcaaattcagaaactgaaatggggagagaaacagattgtgaagtagaaaaccaaagccactttgaggaataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaaaaaaaaaaaaaaaaagtgctgacacagctgagtcctggggaacgatctgtttcaaggttagagagaaccgagctgtaaaccatctggacgctttttcgatgtggctatttaatcatctttccactctgctctatagcatctatgttttcaggttttctctgactcagtaaatgcagtgctgggagcagcacccgagtctgtctgattcaaaattaaattattcttaggtgaattcagggcccagaggcaggctgtggccactatcattaacattatcgccaggcccaagggttctgtctttctcattgaccaggaagggagaatacaatcatctatttatgttaaatttgatgtgtgcacccacagagttgcacatagcatcctcctgtaacaatcttttcagtatttgtcttttgttgatcattactcatcttgtatatttagggttttttttcattatgagtttcatgaggaggttgtattcaaaaaagcctctgggtatatttatgctttctaccattcatttcccttccattacttgacaaattgggggcattctatcattttatatctcttttttccctaacaaccaccttttcttctctgcatttattatcacatatgtatttatctactacaggaaaaacaaaccaatcctttagttagatatgtatctcctcagaaacatgcctagaattttatataaatgggatcatcatacatgtagaccaatatttttaaagtcagcataatgttatttaaacttgtgttattgatataactggtagccccagataatgcaaaaggtgaaatactgtatatacccatctctctagtaagtataaaagttatgagcaaaatattaacaagtggagttcagctgtgtaccaaaatcataatatgctaaagtcaggtttaatgattacaacagcatttaaatatcaggaaatcaatcaacaaaatttattagaactacaaaatgatagaaaaatccttatgattaagtcactaggtgctgaaaaagggatctgataaagtttatcaacagctcctaataaaaatccttgctaatgtaagaataaataattgcttaaatatgctaaaggttgtttaccaagaaccaaccatcagtgaaaaccattctaaatgacaaacaataaaaccatttcaattatagccaggtatcaggcaagaatactcaccatcaccattaatatttaatatgttcttgaagaaagtgcaaccaaaccaaatgattcaaataagaactagaaaatagaagaaaaaaagacaacttttttctcataatagaattttatttctgaaaaacctaacatatattagttttaatatacaccatggaatactatgcagccataaaaaatgatgagttcatgtcctttgtagggacatggatgaagctggaaaccatcattcccagcaaactattgcaaggacaaaaaaccaaacaccacatgttctcactcataggtgggaattgaacaatgagaacacttggacacaggaaggggaacatcacacaccggcgactgttgtggggtgggggaaggggggacggatagcattaggagatatacctaatgctaaatgacgagttaatgggtgcagcacaccaacatggcacatgtatacatatgtaacaaacctgcatgttgcgcacatgtaccctaaaacttaaagtataataataataaaataaaatttaaaaaaatccaaatgtcaaaaaaaactaataagaacatatcttaatatggctaaatacaagaaatatattatgaaatcaatagcttttctcttcaccaatataaataccttgaagtgaaaatggagaaaatattccattcacaataagaacaaaaatataaaaagacttcaaataaatctgacatgaactccagaagattgaacaaagcaaactataagatcttgttagaaatttgaaaacattaaaaaaattgtataatattaaataagaaaacaatatttaaaatgttaattatttgaaagttgatatcaaactttaacacaatcctaattagaactctgaaactgctttagtgtaaacattttgcaaaatgatcttgattgtcatatataagaataaacacctttgtgtagccatgaagcatttcaaaatgcatagtaatgtatactcttttacctgcagtgaaaacacacaagaacgacgttatattcaactcaatgacaataatagctaacgctttgaatacttattatgtaccaggtattgtaattactttattaaatttgtgtatcaattatgaggtaggtacaaatattatctacactttacagaggcataaaaaattgagaaattttcagcatctctcatagtgaatggtataaacaggatatgaatcacagtctgtctgaatccacagtccaagcttaaaactatcaaattttgcatagaagtagcaaagagagtgctgaaaaactggagaatttgaaagaagcttccaatataaacaagtatttgacatgagaaacactagggatagggtgacacacttagaacacagtgctggcataactaactcttcatctacaaagatgtaatgtaagtctcattgtacaaatacacaaaattacgttccaattggattaaagccttaaatgtttttaaaagtctataatttggtttcataaaaagagagaaatttttaatcaaaataggaaatcctgaagctataaaagatagccatatttaatttgccatatatgattttaaattttaattttaagaaaggcaaaattagtagacaaacaatggaaaatatttacaatccaggtaacaagtaaaaggagtatatctacaactgataaggaattcttccaaattgagcacaaaaagacaaataaataatagaaaatgaacaaaaatattttagaattagctcaatcaagcctgaaaccaaggcctgctttgtttgggaaattgatacatagagcaaacgttcaggaatgtgttagatgtttttttgcattcactattggcacttggtgagaaggtagacctgcagctcaaaatttgtacaactgctacaggatcccttgaatttgtaacagggccactcgttctgagaaagacattgtattttctagccaaggagaaagccagcttcaaaaaatcacaacttcgaccaagacgggaagtttgttgatttcagggagaactcatctgtagcacccatcgggggcatccaagcttatccaccagataagtggagccacctaacctggcatggtcacaagcagccaagtccaaaatggagactggggtggtcagaaatgcctggaatcacacctaaccatggcagtggtgagtttctcaaagagaaaacaaattctcactgtctccggcagcatcgttagcaattgaccctccatcaaggaatgtgacccggactaatttctaagtgtaaaagttgcattctttgctggtttcttttggtgttattgcgtatcagccccactgttgccactcttgtaacagctgaggatgtaatcattcatttcttcagcaaacatctagggagcatctctattataacccagtcaccgttaggcactgggaatagaaccgtggcaaaacaaactaaaatttgcttcttggcatctggtcctggccatgagactataagaggattggaattaccctcctaacataaacaactataaaatgggataaaatgtggagagaaaaatcagttttcatgtattggacagcaggcagtgcacagctgtgatccccgagaaaagaaaaacaaatgaatgaaccatgccatcccgtgggctttctgcgtgaatgctgtactgcagcacgaaggggaaaaattcaagacctgcagtcttgccaagttaagaagacagaagtcagagttcaagaaaagaagatggctacagtttatgagatggagtacccaaaaggaggaaactagagaatactcacaaaatctatttaagtaattccttttaatggcaaaaccacaattactttattattattattatactttaagttctggggtacatgtgcagaatgtgtaggtttgttacgtaggtatacacgtgccacagtggtttgctgcacccatcaacccatcacctacattagggatttctcctaatgctatccctccctttacccctccacccccccacaggccccagtatatgatgttcccctccctgtgtccatgtgttctcaatgttgaactcccacttatgagtaagaacatgtggtgtttgaaaaaccgcagttacttttgcaccagcctaatacatagatttccctttgagacctcggttaattattgacctttatatgtgaataatgaaacaccaaaaggcagaacaaaataaaactccaaggaaataacaattacagaactctgttagatgaagtattcccagagctcatatattgtcaggaattatttaagtttattctaaccatgagacattaaacagagaccccaggaaagtagtttcttaggatgaggttcaattagcactcaaatatagtcatgtgtcacataatggcatcttagtcaacaatggatgtaggacattggtcccctaagattataatatcatatttttattgtatcttttttatgtttagatatttttagatatacaaaaattaccgctgtgttacaactctctacagttttcagtagagtaacatgctgtacaggcttggagccttggagcaataggctatgccatatggcctaggtgtggagtaggctgtaccatctaggttcgtgtaggtactttctgtgatgtttgcacaatggcagaatcgcccaatggtacatttctcagaacatatcagatatattgttaagtgatgcatgactaatggccactatggaataacccttaaaacatcttttttaaaaaccttgaataagtcaggttaatccacaaataattaattgcctgtcataaaaagtccaatattctttgaaggaaaacaaaaagtcctaaattcaacaagagagaattaaaaatatctggtgttaatttaaaaataaaacatgatatatgcaaaggagcagggaaatgtgactcctaatgaggagaaatatcagttgatagaaacagaactcctgataacaaagataagggaattagcagaaaaacacatgaaaactgctaagataaatgtattccaaatgctcaaggctataaggaaaaccatgaacatgatgataagagaaattaaagattataagacacccagataaaatttccagagattaaaaaaaaaaaaaattctctagatgatcaccaggttagataccacagaagaaaaaaaaaaaacccctaaattgtaagcagtagcaatagaaaactatttaaaaccaagaacaaagagaaacttgaaaaaaaaaaaagcctgaacagcatgtcaataagctgttggacagtataaagtagactaatatacctgtcattaaagttccagaaagtgaagagagaaaagaagataaaacaaacttttgaagaaataatgactgaatttcttccaaatttggtaaagaactcaataaactccataaagaaaataataacaaagaatatgataatcaagttacttaagatgagtgacaaatagaacatcttaatggcagccaaaggagcgagacgtgtttggaagaacaaacctaagaaaacagctgactcttcaacagaggtgctgcgagccagaggacattggaatgagatcatttaaagtgctgggaggcataaaacactgtcagtctacagttctacacaccacagaaatatctctcaaaaataaacattaagaatttgtataggcccagctactcaagaggctgaggcagaaggatcccttgagcctaggagtttatggctgcagtcagctatgatcacaccactgcaccccagcctgggcaacagaatgagacctttttctcttaaaaaaaataatatatatagatatatatataaagatatagatatatataagatatatataaagatatagacatatataaacatatatatataaagatatatattttcagagaaaatcagacagtatttattggccataaacctatactatgagaaacttaagggaagttctttggagtaagaaaaattacaccagatgaaaagttacatctacatgacagaaggaggtgtgccaggaatgataaatgttgtcaacatatggccaggttttgggtggaaatttttgtagaattagttaactagttctttaaaatatccttccttttctcaaagggtcctttaaatataataaaatatgtccagctcctctgaatgtaatctcatgtaagacttctgtctgaacctttgtcctgctctaaacactgacatggaaagtgaaaatataaacacataaaacctttggaacatgttagaactttcttggacaatagtggcaataataaatctgatctaatatagggtggactataactgacagtttaaaggacagatttcctatatcattatgcctacaagctccccttaatactcctggaggattttatattttgtttaaaaggaaagatccaattataagctatctatgttatctaattttaatataaagacatagattaaaattaagtgaattttaaagctgggcatggtggctcatgcctgtaatcccatcactttggaaggctgagactggcagattacctgaggtcagagttcgagaccaacctggccaacattgtgaaaccacatctctgctaaaaatataaaagttaaccaggtatgatggtgggcgcctgttatcccagcagctcgggaggctgaggcaggacaatcgcttgaacccaggatgcagaggttgccgtgaactgagatcatgccactgcactccagcctgggtgacagagtgagactccgtcttaaaaaaaaaaaaaaaaaatgaaatggattttaagagatataccatccaaaccctagtcaatgaaaatcttgaatggctatattaatattagataaaatagacaacaaggaatattaccagaaataagaagaaatatttcataatgataaaggagtaagtttattaagaagacttaagaatcctaaagatgtatgcagctagcattgagctacaatatttgaagcaataattggttgaaccaaaagaagaaatagacaaatccataatttaagttgtagatcccaacaatcctctctgagtaattgatagactatgtaaaaacatttaataaggatacggaagtcttgaaaacactattaaccaagtcaaccgaattgacatgtgtgcatcacatcactcatcaatagaaaaatgcacattcctctgagtgcacgtgaaacattcaccagagtagactatatgctgggccattaaacaagtctcaatatattgcaaaggatggaaattatacaaagtatgttctttaacagaaacaaactagaaatcaataccagaaaaaatatctggaatgtatcttgataattggaaattgaacaacatatttctaaataacaaatcagccaaagaagaaactgaatgtattttaagtgaatgaaaataaaagcaataatatcaaaatttacggtatgcaacaaagcaatacttaaaggggaatttatatctttaactgttcatattagatctcagctttcacttcaataaactaggaaaaaagatttaaaaccccaagtacacagaagaatagttaggagcagaaatcaactacacagaaaacagaaaaatgttagaaaaaatgaccagctgttttttggaaaagatcaataaaatcaatcaagagcaaagataatggaaaaaaaatcagacaccaagcaaacatattaataatttggacaatataaatgaaacagaaaagtccttgaaagacacaaagtattacagttcaccagttaagaaataagtaacctgaatacctggatattggtgtaataaattgaattcgtagtttaaaagccccacatattaaaactcaaggcccaaattgattcacttgatcaattctaccaaacatttatgtaagaaatagtaccaattctgcacaaacttattagacaaatagaagaggaggaagatatatttccaaaattcatttcttagggcagtattaccctgaaataaaaaccaaacaaagaagttaaaagaaaataaaaccacagatgacattccctcatgaacacagatgcaaaaatcctcaacaaaatattagcaaattgagtccaacaatatataaaaaggggtaatacatcacggtcgaatagcttatcccagcatgcaaggttggtttaacattagaaatcaaacaatgtaatttaccatattgacagattaagactaaaaaagcaaaataacataatcatctcaataaatgcagaaaaagcatttgagaaaattaaacatacattcattataaaaactctgagcaaactagaaatagacaggaatatcttcaacctgataaaagatatctattaaaaataccataaatatcatacttaatggagaagaatgaaggctttctcctcaagattagggaaaaaagcaaggctgttcactctcactacttctactcagcattatactagcagttctctagagtgcaataaggcaaccaaaagcaataaaaagtgtctagatagaaaagaaaggaaatacctatatacacaggaaatatgattttgtagaaaattctaagaaatatacagaaaatatctaccagaacaaataattacatgtatcaatgctacagaaaataaggtcaggatacccaaatgaattttgcatattagcaataatcaattaaatatttaaattaaaatatacatgtacttttatatgtacaaagcatcaattatagtacatccttgggaataaatttacaaaatatgggcaaaatctgtattctgaaaactgcaaaacattgctgagagaaattaaagattaaaaccatcttcctttcaaggtgtttacactctaatgaagaaagcaggcaatatttaagataaataggttaaaaaatataaaatatgtattaatatgattagacctagagaaacaaatcagagaaaggggtataaaaagtcggaggcaaggcagttaatatctagatatattagctattgaaggacatggaaggcctcacttagaaggtgacttgagataaaagccaaagaaatgaaaggttgagagcatttcaggcagaagaaagaggagttgcaaaggccttgagaatggcatgtgcctggcttgctttaggatggacagagactggcgtggctgcagtgaagcagatgggactgaggggagaatactgggagatggatgcagagagctaagagggaactaggtccagcagggctgcctggtcagtcaggactttggcttttcccacaggtgagatgggaagctgtgggagggtttcccaggggagcgatgtgatttacatatttgagagatggccctggccgcctgggaaagcaggtagaaggccactgcagtacctcaggaaagaatgcacataccttagacaagggtaatggtggtgggaaagagaagaaatggttccaaacctattttgaaggtaaaccaatggtattttctgaccacctagatgtagggtgtgtaaaacagagggaaagagaaaagatagccaagagtttgacctaacaaccaagctaatggggttgccactatctgagaagaggaaaaaggttacaggagctggaggtgtgggagtggagtagaagggtctcagcttattcccattgacttgaggtatccatttgacactcaagtacagatgtcagggaggcagttggccagacaagcctgaagttcaaggtcaggtccagtgcgggttcaggtggtctgggctggagacatgaatgttggaatcctcagccagactgcgcatggtttttagaaccatgagactggataacaccacctaggaagtgaggagatccaaatatcaatccttgagcactccaacattcagagctcaagaaaacaaggagaagcacaaaatagcatgaaaagaaccagcgagggaggtaggagaaaagcaggtgatgagtgtccgggaagccaggtacagtcagggcttcgaggagtagagagactggtcatctgtgtcaagtaagaggacagctgagaaattatgacatttagcaaagtgagtctctgataaccttgagaagagtaattgtggttgagtggtgggggtgagagcatgacaggcaggagtttaagaatgaataggaggagaaaaatggaagcatggagaatattttcaaggggaagtagacagacagttttctaaagataaaatcaacattgtctaaaacgtggatagtaaggatcaaatgtatccataagcagggaaacaaaaactaatgaggcatgtttacatctacaggagggtcaaaattggagaaaaaacaccttatgcttccagagaagggaagaaaacatgcattcatacatctgtagtgggagtgcacattccaaaaacatttttgaaaaagaatttggcaatacctatttaattttaaaatttgtaaactgttcacttcacccgtggatatctattctatacaaaaatgtgaaaaccacacatatatcaacaaagacatagattgggatcttcattacaacattgtttatagaaagagctcactagaaatgcttataatctatcctcattattcacagcttctatatttccaaattcaaccatgtgataaagtgtacctgtgagccccaaggtgataatcacagcacttttgccatcgttctcaggcatagtggcagaagattcgagttgtccaatgttggcattcccaactgcagcagaacaaagcactattctgctttctcatttcaactttcatgctgtgaacaactgtccttttctgttgttctatttggtgctccatttttttgcatgtttgtaacttacactggtgatctcactgttgaaagtgggtcccaggcatagtgctgaagtactgtatagtatcactaagggcaagaaggctgtgaacgccttatggagaaaatgcatctttgagataagctttgcttaggcacaactcatgggttgttggccatgagtccaatgtttatgaatcaacaatatatattcaataaggtgtccttaaaaagaaagacacataaaacaaggttatctattgatcatttgactaaaatgtttagactagaggttcaaaggaagctaacgttgagtctctcctagaagcaatggttcagtatccactagttgcacatgaactagtgttcatgatgactttatagaacaaagcaaccataaataacaggaatgaattgtctccctttgttgagaattgtgtgagtaaattaaagtatatcccaaggtgtgcaccatgtgatattacgagccctttaaagatcactactcaatcaaaggaacccaagtccttggagtcatttccttaaggtactgttgcatgagaaaactaaggtgcagaggaccataatatgatgtcactttttttttcttttggagatggagtgtcgctcttgtcgcccaggctggagtgcaatggcgcgatctcggtccgccacaacctctgccgtccaggttcaagtgattctcctgcctcagcctcctaagtagctgggattacaggcatgcaccaccatacccagctaattttgtaattttagtggagacggagtttctccatattggtcaggctggtctcgaactcctgacctcaggtgatccacccgcctcggcctcccaaagtgctgggattacaggcgtgagccactgcgcccagccaatgtgatgtcatttctaacctttgtcatctctctctgatttcatgtggttgcctgagcatgcatagagtgatgtccaccaagtcagcaatgtgggctctgggggtgggtgtgggtatctgtggagcaatgtgcttgcagtgcagagggcaggggcaattaaaagaaaacagcacagttgatggtatcatttatgtcggatgatgtttgtactatgaagaaatttgaaggaaaaagtcacagttagtcttctatgtactgacttgtagggatgaccatgttggaaaaagagcaagttgcaaaataatgtgtgcaatgtgattctattctagtaacaactctgcttattatatgtgtcttagaattagtgagaaaaaggtttctaaacatatcaagaggttgagagttttgtagaaaagtttgctttttaacgcttatttctttttcttttcttgctctctctatttttttttctgagatggaatttcactcttgttgcccaggctggagtgcaatggcccaatcttggctaactgcaacctctgcctcccaggttcaagtgattttcatgcctcagcctcccaagtatctgggtctacaggcatgcactaccacacctagctaattttgtattttttttcttttttagtagggatggggtttcaccatgttggccaggctggtcttgaactcctgacctcaggtgatccacccacctcggcctcccaaagtgctgggattacaggtgtgagccagtgcacccagcctttaatgcttatttatattggcttgtctcagtaagtccaataagtatgttttgttgaaatttgaaaaaaaatacaaataaaatatgaaaaaacatcaattagctaaatattattcagctaacaaagaaaggatatagccattttaatagctaattaattttgaaaatggcaccagcagatacaattttattataagattctgacttgttgtatgtaatgctttaaaattctttgtctattttttcttttaggaatcattaagagccatcagatatgaaatatctccagatagagagtatgcacttttttcatacaatgtggaacccgtgagtattatcctttactgcctacaaaataattgtttctttattctaatatctcattaagtatatttccttgactcttctatacttagtgatctttgaatccagaaatactttgtacatcctggaagtctcttttgcatatcatactgccacctaggagagaggaaaggtataaatatctgcttggcaggggaaaaaagtcacatactttagaggctctttcatagacttttcttaggaggatggtaagaacttgtctcttcatagacacaaatcttgcccttttgtgcaattatttttctggctgttttctcagtgaaataatagattttatcctaagaacaaaaagcaactgccaggttctccttaaactgaaataatatgttaattatctcctggtcattgtagtgttctagtgaagagctgaagctatcacttccactatttaaatgcctatttttagcacttcctgtatatatgagcctcccataaaatttcaccagaattttctgtaaaatctcactgtgtattagtagcagtgtaaaacttcctaggccaggatcttccttcttcttcttgttttttcatttgacatgctcgtatttcaaatttcattttggctctttaattttaaatagttggaaggtgaagtttatttgtataagtggagaggatgttcagtttacaagagataagcaactttagaaatgtatgttttaagaactttcctctctggcaaataagatatagagtctactactgcctccctggcatttctgagaccatttgaaatagagtttcctggtgcttctgtgaggtgtaatgactcctgcattttaattcaggtcagaatggctctgtggtgagtttgagagaatcttttctggcatgagacagtcaagctttttggtttatatccactgggaaagctggggtattggtttgtatgaagatgcaagttcaattctgaattcttaaactttcttttagaagttgattggacaactggattactggagatttcaactttattcttccaactgtagatttttttggactctgtttcagtcttccatttttctatttttaaatgtccattctataaaggttttcattttttccatccaaattctttgaaacaatggggcatctttgtctctttgattgggatcagttggtgaacttgacattctaaaaggcttgggactctgcattacctagacacagccttaaacttgcctctttcagcctcaggcacctggatgtgatgttcacgggtcatagaccatttcagcttccttcatcacccttgaaaaccaccagaaatacaatctccacacctgtataaaagaaaaatgttagcagatatttgaaagccttacatggatgtgttctggtttgccccaggaggcacagctaacacctgagtgagaaaagcctagaaagacaaattgatttcaggttatcctcctagagaatctttaatcatcggagcaccccgacagtgggatggaggtaatgagcattccgttcccagaagcctcaaaacaaagtgaggtattgttctccggaatgtgacagaggggttcccgcagccgtgtgatcggaagaggcgtgctctagtcagtggtgctgtggttctgtgcatgatacaattctccaccactttcttcggcttcccagcgctctgtttggaagagtgccctgggatcccattgaaccagaaaccattttgataaagatcattttgctaaagatgagtcttcaccatgtggagcactggctgtaaacaggaaccttgaaataaccctttctcactgggcagcatctgtcggtgtttggagtaagactcttcagtttgtcttctcaactgaaggaaaacctaggaagtttgaagtgtatttacagaactataaaaatgataaaattgaaaatgtaaaaagtctatagaaacagatattttaagttgaataaaataagtaatccttaatagttttcagcactgagcagttactgtatacatgactattcaagcaagtattctctgttcttctggaggaaaaattataagggaaattataacctataggttatgagtagtgtgtcttctctctgaactccttagcgctataccaagatacaatccaagttcttgaaattctatcaaatccacaaaatatgtaataaaaggattacatatgggattctgcatgagaatttggagttagatattaggaagatcttcctaactagataaactaaaatgtaagtaattttagaaaagggaggggtaaatttcaaaggaagagtctaggtctgtgattctggaataagtggaatagaccaggacttcctaatcagtatttagtatcagtaattgttattgctagtattgtattaatagtataatcaattaaaaatattatccattggtattctttaaaaacaattaaaggttccatattcaaatacatttgagaactctagttaaacagataagtttcttgaagttcctgatattctcatgttggttacatagtacttcccaagtgggtattacaacatgtgattccaatctaattataatgaaactagaatttgttatttggattcatgctcaacatattcttatgtgtgtatctcaaaggcagctagtgtaacttgtttatatgaaccaactcaacttttcattaaaaagactatcataaaattgttttagtgtaaaccaactgtccaattactagatatctgtcatttatttcagtatatgtttcatttgcaataaaattttggtatattgggttaccactgcactaaaaaaaaaaaaaaatcctactatcccacatttcgtcaggataattataatctcttcaatctctgcttctctttgttgcctgcccaaagatactggacttggaagtcaaataatcataggttcaagggctcattccgatgctcaccagctatgtttgcttgagtaacccactaaaccttatgcactgcatcttggagccatcttcctgggtgaccctgggcttctgtttctcagtggtgaagggcgacccaatgaatgtcagctctcctacacttccagggtatatgtgtttgagcacagagtagttccgtatgtatacccagggccagatttaaggctctatccaatttcattggaatggagttgatggatgcctacatgaaatcagctgtcttggcagtggctcaagtagaagtgagtaagagctttccagcacagcatgggtggtaagagaaatgaggaaacagatcattaaggagtttagacacaaatagtacagcaacatcctgagaataagagttgaaggaaagatgtttaagtttaatttttagaatatgcattgggtatctcttcttctcatttattcagactaattgcaatgttatatcatttcccagttgtttggcatagactaatttaatttgtccatttttatattgtcagatactcaaagacagggacaggtctttttatctcctatctgtccccacctcagaggacccagcacagggtgatctgcgtacatttagtactgagcaaatatatttgtggtgtgtgtatattctctccgaaccccttagcgctataccaagatacaatccaagttcttgaaattctatcaaatccacaaaatatgtaataaaaggaaaatacctcagttgtgaaatatcctaataacgttccatgtttattctagaaatgtgggatcatgctaattagcatgctttttcctactaaactcttctaatattactaaatgtatagcttggctagcatccttgaacatacacaagttagctcatcttaactatgccaaccctatgtttttttgagagctttaaaagtagcctttaaaaaggtgtttgaaatatcaattatcaagtaaatttgagaaacagcaaacccaattttccactttttcaagcctcagacacctataggttataagtagtgcatctggaatgttgaaaataataaacagtattgtgtttgtatttatgtggcaccagcattatagtttgcaatgtgtgcttatttacaccaccttattttatctcaaaagatcattcctgctccaaagagacaacatgtgctaaatgagttttattttattttatacataaaatttcataacatttctcagtgtacacttcctgaatattctcttgaaattaagttagacattggagaaatagcaattttttatttttaatttgaaaactgtattaactatactaataaagaaaaattgccttaaaacaaatgtatctaattagagcagccatgcttttttatattgagatatatttgacaaatatgaaacatttccaaatctctttggggagagggaaaaagaatgtaaaatgcattatctaagatcatttaaaaatattaatactttttcctactaaactattttaatattactaaatgtatagcttggctagcatccttgaacatacacaaattagctcatcttaactatgccaaccctatgtattattgagagcctaaaaagtagcctagtattaatatcttagatcatttaaaaatattaatttcaaagacctaagagaaaaatattcttccttgaagaatcatttctgaaagagtcactgaagatttgtgaggaatttcattgcaatatttaaaggagttagttgaaatgattgttcttagtcagatcattgccagtggaacatcattctggtccaaatgaaattctgtccaaaatctggtcagattttaagatttttttcctaaaatcccaatcacacagtcattcagtcagtaaaatgggttgatacactgatctgtttataaactgttcatataactgaaacacataaaccaatccgttttagttacttgccactgcatagcaaattatccccaaacatagcagcttaagacaaacaacatgtatcatcccagtttctgctggtcggaaatctgggctcaagttagcaggatccttgcactcagggtcttctataaagaagactgtggtcaaggtgacatccgggctgcagttgcatctgagagctcacctggggaggagtctgcttccaagctcagggcatgggtgttgacagggcccaaatgccatccttagagatgggttctgctcagtcctgagagaagatggtttgctgctgagcttttcatggcaggaattggaagcagttttcatatttgataaatttctactattttcctgccatcgtggtgagttgatagagcccattttgctctctaagggactgtgaaatttataattcatataaagcttgaagaacaccctgatgtggataatcctgatcaaacctgcttggtgaggtgaaccccaactatatcccagaatcttctatgcacccatctggtcgagttacctatttatctatatcttaattaattttaaaaaataacttgaggctttataaatgtaatataagggattgggctataaattattgaacccatattgtggactaaattataactgctggaaatcaattcaggtaattctgagtatatgagtttctttttttttcttttcttttttttttttttttttttttttttggtggtgtctcactctgttgcccaggctggagtgcagtggcgtgatctcgactcactgcaacctccccatcccaggttcaagagattctcctacctcagccttctgagtagctagcattacaggcacccgccaccacacatggctaattttttttttttttgagacagagtctcactctgtcacctaggctggagtgcagtggcacgatctcagctcactgcaacctccacctcccaggttcaagtgattcgcctccctcagcctcccaagtagctgggattatgggcacgcaccaccacacctggctaatttttgtatttttggtatagacagggtttcaccatgttggttaggctggtctcaaactccttacctcatttgatccacccgcctcggcctcccaaaatgctggggttacaggggtgagccaccacacctggccaattctgagtatatgagtttctttgttgcaagaaatatagctattgttataatatggttctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttattagaaataagaattagtgaaatcaaccactttttaagttacaaaatattacaatgatcagttttaacctcaccccctgccctgaatgaactaattgtttttcttagagccaggtaagggcctgccattggcaagcttgcaccttgagttagggttagagttgtcatgagtcaaatgccagccatgtcctcttctgccccccatgggggggcccaaagtgcaggagtgacagagaggaacagaggcagatgggcagcagggagatggactggcaggtacctgtgtcctcacaggtaattacgtgtcattccctctggatggtttctgaactgtgggaactcccccatgtgcattgatgggagaagagccaggcagagacacggtaaggagggcaagttatccatgtgaccttagggatacttggggcaaaagtaggctaacctccgtgcacaccctggaacaaaatctttaaaagagagagcacagaagagagagagagagcactttgcccggaatgagccccataatcagacaccacatctcccaaattagcagcacccttggtttctgggcaggctgagtttcccgcgcgtcggaggggataggatgtagcggtgaataacagtaagactccaaaatcaagtgggtatgtctgacgatctgcctctctctcccccttacacacacacacacacacacacacatgcacacatactctccctcccccttacacacacacacatactctccctcccccttatacacacacacatgcacacacacattaacacacacacacattcattgctcttagtatatttcctccctacctccttaactttgaccattgacaaatttttctctcttaagaagtcttgaggcagtgcactcgggcataactcccttccttgtgatacatccacgtctttgtgaatgatgaatggaacgttgctcacttgttagtaattccaacagacaaagacgtggcctgagactgcccctcacctgctctataatggcttcttgcagcctgctttcctccctccagcgctgccgttagagcctgaggggtccaagggagtcagtctgcccccgtgagtcttcatgtggtgtagatgatgtcagggtcagaaactgacattcaacacgagctgaggcccatggtcccaaaaatgtgtgtgagctgtagttgtccaaagacgtgagaggacaagaggcttgagtcagggaaggccgacggagaagaaagcctggaaggagaggaggatccggggtgaagaagagaggaatggggagaaccttcccggtgcgatcactgcagaggaacagaggccgccatgggaaacacctgcagcgagcatcagcgaggagctgaaagtgctcaggtatcaaaagaaggcagaagaaagagcagcaaaaaggagagaaaagtcaacataaaaatttaacacgggtcccttctgctgacagaagccttcccagtgcctattgcggccaccttcctaatgtgacctcagatccaaatttagaaacagcctctgttccctccgctcccagactgttttttctgcttgccctgcattcatttcttggaagttttttaagtatataagagcccaggttggccagggcaggggttagggaagcaaaggaactggaaacctgtgtccgctgaattgcagagcaggaataagggactctgcagaaaagagcatgacaaagagccgcggatacaagcgagggtagcaggagaaagagctaagaaggcagaggttagttgtttgatcgtgcacttggggaaggtggagggagaaggggccgtgaagagatggaacggactggcagaggagatttgtgtggggaaaaggagacagaggggacaggaagaaggggacagaagagtaaagagcctggaagggccagggaaccctgcctgccatggtcctcccccacttcctcccacacaccctgatgcaactgtgactgccctggcacctcagcagcttcagaacagggaaaggaggagaacacgggtttcacaggaggagaagcaaggaggacccagggagctggggtgccctgtgattctcaaccctgtccacatgatctgacctgggggatgagagcttattagatccaacttgagttgacaacaaagaacttctggagcctttcaggcccttttgaaacaggcagatcttctctgcagtcatgtctaatgcagcaaagaaaacaacagtgtcccctgcaggtgcagggacttctggcctgagacagcagaataatcgctcctggagtgggaaggttggcttgtgtattgtgcgcggccatcagcagcatctcatttcagactctctcatatccccggaatgtcccggggttaccgaaaaggccccattctccttccacctgccttctcctgctgctagaaaccaggatttttgactattgtccctgcatccccacatgtcacccagaggcagccttaggccccctgtcctgggccacccttggcataactggagtagacccgggtgcctaccacagcctccttttcctcaagggcagctgccctctcggtgccctgctcactgtgagcaaatacatatttaaagacatattctgctacttcccaaagggaccagccaccacctgcactcctcgtcctggtggaaacagtctgagtgcttgctttggtaatcaaaggtttcattgagtgcagatgtagtgatcctggcaaaaccctggaaacagaaagtcagctgaaggggtgtttctggagatgaggaattgtgctggttagccacgggcatgtcctgaggataattatttgtttacaacatttctgtgaacaaagaacatatagggacagaaataagttagtttccaagaatcttgtgatgggctccatttatctgacccattgggtttgtagaagaggacagaatgctgctttggttctcctccttggacagtggaactagagaacgggaagctgagatggccgagctgagtggacagaggagggaggaagcccctcacctcgcctgcttcccacagggtcccttcctcctcctcctgtttcctaagcttctcagctgggcttcagatgtcaaggtttcctggcttctgccacttcaccttctcatcttagctgccactggaccataagcatttcaggttgctcagatctctcccaccgcaaaataaagcaaagacaaaaaagttctctctctctcaacccatacccatgtcctcctctggttcttcccttcacagtcaaatgactaaagaaagaagcagctgcactcacctctctgtcccctccccactcactcttccgtgtgtctcccacagagtggaatgagtgctcagggctcagccacccagcccctggggaacagtatgagtgtcttccccatgttatacccccgggggaaggtatgagtgtcttccccatgttatccattaggagacgggctttgggagattgcaaggtttctgcagtgccagggatggagggctgtggttccaggtattcctctctgcaaacacctgctcttgatgggggctctgctgcccctgagcccactggtaactgtacttggcccccaccacacagcaaaactctcacccatcttaccagcagtcttctcgccctggaattcactggtgcctgttttaggctgcctgggctgccatggcaaaataccacagactgggcagcttaaacaacagacgtgtgtatctcagagttctggaggctggaagtacaaggtcaaggtgccagcaggtcggtttctggtgacggctcacctcttgtgtaattttgggtggacacaaacattcggtctatgtgccaatctcctcaggcctcctgtggcagaatttgaggccgctcacccctccctcttcctcagtccttggttccacaggccctggctgccctctggctgcctcctggccacttaggaggtcctcaggtgctcagacttgattggatttcccagtcccacccaaggtcatcttctcttctcttgcgcactcaccctgggcaacttaacctactacggcaactactgcatcggctgctgccacccaaaacgcgatacactgagtggtggcagaagcctccccaggaagcctgttagaaacactgactcgggacccagcccacaccctgatcagtcagaagcctcgcgtggaggagatctgcatatgattcgtgcgcacactgctgagacacatgaacctcaacaacaaggctcccgcatcacatctctgttctggacctctgactcgggtgtcagacctgtgtgctgctgtctccggggaacgtagagggccctcagacacagtgtgtgcaactgatctcatccgtttaatcccacgttggccccacgtcctgcctgcaacatcagcactttaggaaaaacaccattgtcccctccttaccaggaccctggctagagaccttctgtctccctggcccaggcagcatcgccatccccctgcctttgggatatgtcccttccacttccccattgccactgcccagttcagcccaccttacctgttatctaaaaaaccacctctgcctccagggcctctttgcctcagcctccccgccccacacttcttcaatctgtgctggccacgctgccttcagggtgacctttctcagtgccaatcaggtaactcattcccaatctgcacctcttccctaacccccttgctgtcccacctgctccttccctctcacctctgggcctttgcaggcgctgttccctctgctgggagcacctgcctcctccactgacctcacagttctcccacgcccttccagcctcttcagcagcaggccttggactccacaggagtgggctcccatacccgtgcacacccacggggaccacagcactgctgacggttttccgatttcctgcctatgagtccccgcactccaagggactttgagatgcttaaaggtggcttgggacatggctgatccacaatagagcctcgagaaatatccgacccattgcaaaatggaccgtcccccacccccatgcggtttcagggccgctcccaggctgtgagtgtttatgtgaaaggagtgtttgccacgtcgctcgggacgcccatcctggcaatgagcagctgcagcttccaggattttaccttcttaaatgcacttctgttaagctgtgcatgtaagaggtctgttctgttgaaatatttcccagagactttcatactaaggagggctttattgttataaatatttaaacctgctttgcagccagtcgctacgattactcagctcagaaagcatgcacaaagcctgcctctagtggacgatcctgtgctattcatcggcctctcattttaaatgtcttcctgatttcaatttaaaagcgtatctttatataacatatacaatttaactttttctttttaaaaatatgtatagctagtttttgttgtgcaattctatgagctttaagacctggatagacttttgtaaccatcaccacaaattgggatatggaacagccccatcaccccaaaaaactccccctgctctgcttccttcagggcaagccctccctccacccctagtccctggcagccacagacctgtctacagtcttgtagtttagccttttctagaaggtcatataaatggcatcaagcagtatataaagactagcttcaaagtggagaaaactttaggcctctaaggcattttaatgcccgcatagtcttcatctttagggtaattttgctctaaaaacgtttttgctgttttggtgaaatatgtaatactaggatagactatggaagatgtgcttactgagttcttaccctcaatgtcaaaaacccaacagactttcattactgcatcccctctgtacaggatcaaagtgcccacccttagaaagtctgatgagacagagaagaatgacttgcgaggatcaagaaagacaggctgagtgagcagtgtcctggcctgaagcctctgagcactgcggttgtccctcagcacccctggggagtggttaccagaacccccgtgggtaccaaactccacagaagctcaagcgccttaggtaaaatagtgtagtatttccctataacctacacacatccttccgtgtacttgaaatcatctctaggttacttgtagaatcaaatacaatgtaaatgctatgtaaaaagttgttctactgtattgcttaggaaataatgacaagaaaaaatctgcacatgttcagtacagatgcacccatccttttctttcttcccgaatctttttgatccttggtggttgaatttgtggatacagatctcacaatactcagggccgactgtaattctgaaggagggggctttggggcgggagcctacaggaagctggaggcagggcactggggacttgaaagtgaaaaagtcagtcatgagcatgggagaaaggagaggaaggcaggggaaggcactccagatgaaagaaccccctaagtgcaggcttgaggtgggatggcacagtgagggcaggagagggatgatagatggtccacctggagcacagtatatgcagtggaggggcaagcaggcaggccaaggtggggctgagtgtctggagttgaccctcgttgccaccgtcttggagggagctgaatggttccagagtagaggctgatgccacgtgaccaggtgaggtgtcttgttgagaccgggcacagtgattcatgcccataatctcagcactttaggaggctgaggcaggaggattatttgaccttaaaaaaaattgttctgttgaacttattgccttgagacagaggagctttcccaggatggccatttcctacctgccggcctcagctcccatcgcctgcccttatgcccactaaacgcgcttgtccaatctcatggttaaggagccacgggttatggttttggccccatagatgagggagaaatttgctggagggcctgtgggagtctttggctctcttgcaagaggaatacagagttggcctttctcttccccactgtccttgccttcatgaagctgtgctgcccaggctgtcacggtgggacacggagcccagcccctgatggcaccatccatgtgttgctctcgatccctgttctctagattagctaagccagaaaaattagcctgatttgtctaagcgtctgcccatcgggttttcccttacttgccactaaacgagtcctgagtggctttgctcgtgctgtttcctccacctggatctccttctctaccttgtccagctggtgatctcttccatccagaaatttaacttcagtctgagtgagcacctccccagataccccaggcatcaaacacaatcattgcttacagggctgtgtccctcatcaaggagctgtgagcccctcatgagcaggaactgctccttacttctctttgcacctggaaggtcataaatgatcagcaaatattcgttggataaatgaaagaacaaatgaattccatagaaacaagcaagggaaaaatgggaaatgatttcatcaattcttgctaagtcacaggctttcttccttcacaaaaggatgcgcaagagagttgaggatcttgagtctgacaagcagagaggtgcttcttgttgtatttatcaaagcttcgctattaatccctgcagggtcagtgaacgcatgtcagctctgcactcagtcctgctgcacttcggtggactctcaccagaggtcaaaggctatcagctcactccttttgtctgaccaatgccttgggtggctgctctcatcctgacttgagctaaattgggtgatctgcctggagacttagaaccttattcctccccccaaccattcccactgcctttgccttgatctggactcttctctcctcttgccaggaccaatgctgccgctttccacctgtccttccctcctgtgcatcccacacagcctgcagctaagcatggttctgagcaagacacagcttcatgcaaaatattgtacctctgcttgaagacccaatgtgaacattgcccattgatttttgtttctcgatccccaacttcccatgccccaaaatagcatcctgggaccatagaaatggaattgagctttctaaaatgattctgcccatctcccactttacagatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaatacctatgggcctcactgaattaataatttatttatttctaaaaaaaggttttattaattaagtcaaaatttcattgtaattttaaaataatcttgtggtctttctccatgtgtctgaagcttgtaatcactcttattgtcctgtgaattctgatatgcagttacctgctagcttagtgggtaaacattttctctattaatgagcaggaggcttattaaactgtgacagtttagactattctttcaaggccattgatcagtgaaaaaacagaatctggatgctaaaaactgtgcccatgtgaattaatttacccccatctttccctgagccatcacctgagtatttgttcctaggtttgttggctgcatttgcttaatttttatcttgtgatttcattgagaggtgtagttgagtgggtgtacttacagcttctgttcctgtttgaaatatcatttggaaacctgatcacaccctgcacaagtatgcttgtgaggcatactaattcaataccatttgagcaggtgcctcctaacgctgccctcctcaacctttctcagcatgaatgtacgctttttcatgtgctgattttaacataatctttggttcacagtaacagagaattttgtttgaaaaaattcagggattgaagggatattgacatgtacctagtcaccatctatcactccatctcaggagcaagtgttccttgctctcgtgactttgtcctggtgacacagaattcatccttgtagaccacttactttcttcccaggctgggcagttctggcttttgcaaagttcttcatcagctaatttaagtctgctttttaaaacttcccatctgctgaatctcattccaccttttatgcggcagtgtccactgcgctttctgcagtgacggaaatggtctacagttgcactggccaagatggtggcattacccacacgtggctcttgagcatggggaatgtggctggtctgacaaaggaactcaatttgtagttttctttaattgtaatcaacttaaaattacataggccatatgtagctagtggctaccctattgggcagtacagttctaaagcaatgctgaatatttaacgaccttcagatatttgcagacagctctcctatccacatctttagccttctttggcccagccgaacaagtgtttcagatcatgcctctggactcctttctgtctccggacttcgtaacagcatggtcacccttcattcacctcattagatatctgaagtaatgacggaagtaatcgattgagtaaattagtgaatgaatatgtgattttaattcttcacataaacctcatcctagctaatcctcttgtcttctttataagctgaggtttttggttttatgactgtggatgggaagaggggatgcagaggataggaccaagcaaggtcgtattttctttaataaccacatccccacctgtttcccagttgggaaaaacacaaaccgatttgctctcgggtaccactagtttattataataagatgtacaaagcaaggcagatgaccctgcagtgatagcagggatggtcacttgtttggcagaatggcccaggggagcatctctagccgtttcaatcccaagaaagcaccttggggtagagatgatgcaaaaccaacctgtacatcgaaatctattttttattattcaaaaattacaacctggtcttctgaaacttatttttttatgcttttacatctcctacagccttacacataatttctagtgtctttttagaacctctcagtattgtaacatttaatgcgttctcagcagcgggtaggtccgtgttatgtttgcatttgaagtagaagagctaagctaaaaaatatgcctttgtttactaataaggtagatactatttttttgttgctgttgtttgatatggagtttaactcttgttgcccaggctggagtgcaatggctcaatcgtggctcactgaaacctccacctcccaggttcaaacaattctcctgcctcagcctctcgagtagctgggattacaggcatgtgccaccacacccggctaattttgtatgtttagtagagacggggtttctccatgttggtcaggctggtctcgaactcccgacctcaggtgatccgctcaccttggcctcccaaagtgctgaaattacaggcatgagccaccacgcccagccgatactattttttactcaaaccaaaaaatatattctgcgagtaagtgatccactgtatctcagcccataatgatggcctcgacaaggaatgagatggccacagtcagtgtcacccactggaccacagtgatgggcgtggtgaaccaagaagtgtggacatggcactgtgctgggttacagtagtgagggaagcaagcttagactagggagcaaaatcaacctgtgatgagttgtgccttcctttaagcatcttggcatttgttgttggcattgaggttatagaccggtggtgcaaagacgaggccacaagggccactggagaagagggaggagagcccaatggctagaatctggaaggacagccacacgtttccccctctgattctttaattcacccacaacatatgcccatggtgagttcttcaattgcaggcttttggtacaggaaatgagctcttgctagagatttaagacggagtcaaatcatgggtctagccctaatgatgagtaactgatggtgaggatgagagttgtgacagtgctggtggtcatgaggaggatgaggatgatgaagaagaaaacagcagtaacaaggacgatgatgaaaacctgctaattatggtgctgatgccagggataattatggtagtgataatgatcatgatcccaggaggacttactgtcattatttctcagtggcttttctttgggtagagagtgagataattaaagtctggaaggagacaggaacagggggcgtgcagttcctcagatccatgggtcccgcccagctgcatgctgggagtgaaactatcaagattaagagctatgctgtttcagcagcatttccactgtctaaatataaacagcctcaggccctgatccagcagaggagaccacagctgccaaatgcatcgccagctgcaggccctggctgggtttctttaggggaaaaggccatcccaccatggacaggttccaaaaggcatgagcctgcgaatagaatttgaggttcaaggaatgctagactgtgcgtctgtgttcagggtcacagagcgagtctgaagggagcaggatgaggacatgggtgccctgcctccagggcctgtgctctctgctggtacagacaagggcctggtgagatggtagaacaggggcggctactgcagtggtgccacctgcgtaggaagacgggaatctagtggggatgggcaggggccaggctccctttgctttcgcaggcacccagctccagtggcccctcagtcccagctacagatggactttgagatctgatgacaggatctgctgttatcccacctctggatcaacggcgccatcatcggtgccccagctagccagcagatgtgggccagagtaaggcttgactggtccacatgtcctttctggcttaagacactgcttatcttgactcagggagagaaggaaatggaagaagaagaagaaagaagatgcatttaaaacatattaccaaactaatgccatgaacacatgaaatgtcagccttttgattccctcctgccaatacgcatccgtttatccagtgctgacttactcagccctgaacatgcaccaggcgctctcgcaggcacagggaatactgtggtggacagagccggggaagcccctgcgctcgtggatcttacatcctgctggaaagaccgtgcataaatagatgtgtttatcatgtgtcaggcaggacacgtgctccacaggaaagtgacgtaaggtaaaggacagggagcaaaggggagtgtctgggggaggacggcagggacggcagggacggcatggaagcagtggcccagcagacgcaggacaaggtcctgtgatccgaggaggggtctcagggtggagggacagggagcaggccagcgtggctacagtgcatgatgtccaggatgagcaaacggagtgatgtttgaacatgtcatccgggaaaactacacacaggggcaggctcacagccactttttccccagctgatcttgcttcctctgttaccaaaccaccctcaatacagcctcgcaaactgagcaacagaggagggggaacacaactaataccccatttggcaggctggctgaaggctgttgaagaaacagcagaaacacctggtaatccttgcaggcgtcacccaggctgcgggccggagctgtcatgggacaagcaggaggctggaatggagctgggatgggaaggaacacaggccatcagcttcccaggccccacgttaattgtgtaatatcatcacagcagggtaggatgccctgtgagggcacctaacaggtgttcatcacattcatcagcattgccctaccaacgaccgtatttacatcaggcataaatgcagtttaccgcactctgtgagaactggggattaatagctccggtccagctagattctgatttccttggtaggaggaggcagaacagcacacatcttgactgaataatcgtgcattttgcatggttaataattctgagagcaggaaagctaccttcctaggatcacagagagcttactttcttttctacgaatctttgaaaaaccaaacagatgggattttaccttaagagttagattgcactcttacactgtgctgttcaaattatgaattggcctcacttggatgttggactattgattatcaactctggcaagctctttattcagaatcttaggacatgcacattaaaagaaaaaatcctctctttgacctggttgccaccaatgtgtatctacataggatgaaaaaatgcatcacgtactcagaagaacgggctgcagccccggagccccagtccttctgccagctctggagcagggggagctcctggctgcacctgaggtgtcagtctccaagaacctgagccctttccacacgcatggctctgttctaggcactcgggggagctcaaacagaaagagagtaaacctgctgctgttcagtcagagacccaagtcatactcacaaatgatcaagctagtgaactggatggcattttcacagctagatcttgtactgcaattatagattgtcaccataaagcttttgagagcaatttaatagttaataacatcctaattctatgatgtgagtaatctgtgctctgagaacggcctacatataggcagaagaaccatgaggagctctcaaagaaaatgtgccatatattcaggcacctggggagtggttgtagaaagtgtgaccttccaaggcaattgattttggttgttctttaaaggatcactctagcagtccggtcattcttatgggtcctctggtctagatgcccctcatggaggatcttctaatcttgcattattagaaatggcagctaagtggattatggatggaaactttcatgttgtaaaaacacaccaccagaagtcaaccattcttattttgcccacgtattaatgctatttccaaaactgcccgacagctcacgggtgtaggggtttaggggtctatattccttgttagactcaagctccttgaaggtagggaatgtgtcttactcattactgtatcctcagtttcttgccccattgtgcaagctaaataaacaatgaatgaatcaatgaatcaatgatgaataaaaggaaattagttaaattccccttagatagcaataattgtccttctcaccccaggttatctacagccagataccatttggattattgaattcctaggatgttccttgcctctctgattgtttgccatctaatcatatccactcttatgtttttatttaacttcttagtatacatacctgattcccacctttaagtatcctaaaggaacacaatgccttatcttgctttccctccgcccttggcacacaccacctaccacaacgttgaacttacagtaaacgatcaaggacaagtttcggactaatgcatttggatggaatggcttctgtggctttcaaacagaattctagatctgacctagaccagacccagatcctgcctggatgtcaggacttccctgtctctagagaggcagcatgaacagagacacaatgccgggcggattgttctgacctggctcccagacccaggccaggggccagggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcctgcccttgtctcctgccagcttcctccttttctgcactcagccttaccctttcttccccttatgcttcctttctgggactcccaaacccaactgtgctttagagaaagagtcctggactcaacgccagggaaatgcatgcccgtgttcctgccttgctgccttctactctgaccttgagaaggttatgaactcttgggcttccattttgccatctctcaagccagtgagttagaccatggatgaaagaccgcccatcctaggattataaactgggtaagatttgcatcaatgtgagtcttcacactgatgctggctccaggtttcctttctccactgtgagctgagttaaaaactctctattaggaggcatttcacataccattgtcgaggaggtgggaaataacaattccattcatttgccaagtagaaaagcccttgccttcttggttcattcagcagagggaaaagtaagctaggcggaggcaggaatggcctttatttgcaaaggaggctgtgcctcactgttcttcaacaggatgcctaatgagttagaatttgagtagcatggctgggtgcagtggctcacgcctgtaatcccagtactttaggaggctgaggcgggcagatcacaaggtcaggagtttgagaccagcctggccaacatggtgaaaccctgtttctactaaaaatacaaaaaaattagccaggcatggtggcaggcacctataatcccagctactcaggaggctgaggcaggagaatcgcttgaacccaggaggcagaggttacagtgagccaagatgtgccgctacactcctgcctgggtgacagagcgagacgccatctcaaaaaaagaaaggttatgcctcacaggttctgacattcagtaggatttgcactttggtgcatttttctttgtacataaaaccctcatctcacttttagaacagtgcagtacttaactttttccaggattaggtattcatttcagtcatgaaaaagaaaagggcatttgacccaaattacaaaaactattgaagtaaaactgccctattttttccttcatgctttcattgcaaaatgcagtgactgtctgctgctggatgagtgtgtatttgggggctctgagggatggagaaggagaggcacgactcgcaagtgccaggaattcacattccgctgacgcgggaacacgggcagtgtatagacattgtacagacattgtaaagacattagagcacaattttgagaaaacgtgaaaggatttccacaagtctttatgtcctctgtatattaaggtgttaagacaatggatagcaagagaaagatgggattttgtggcagaaacttccaaaaaaaaaagttgacatggagcaggtcctcaaagcaggaggcctcagagtactttgtagtttaagtaggagggaggactcgggtatctggagatgggaatggaattaccagaggagaggagcattgaagaaatggcgtcaacactgaagaatgtgctgctttataagaataatgagcccttaaatgccagtctgaatcttagcttgacaaatgaggcgaatctgaacacctttgggataataatagcgccttgctctatttgagataaaatccatttcttctgacttctgaaaggaattattgtattggtccatttgttttattttaggaaattttaaaatatgaggtagaaaagtataaagtattctccaagttattagctaataattggctgatgtcacccaggtggttatataataaactgtctcagtatcattaaattctagaagtccagaagaagaagtcaaggacttcttagtattttgaggcagagggaagaactacaaaaaaacctcagggcaggaaaattggacctgttgcaggccctgaaagctggtgtgatttgagtacagtgagagagagacacagagacagagagggagagaagacagagagagagagggtggggagacagagaaggagagaagacagaggggagacagagagagacagtgggggccagtaggggaatggaagcacaattgtgggttggtgtctcctggctcaatgcctaatgagttagaatttgagtagcatggctgggcaccgtggctcatgcctgtaatcccagcactttgggaggccgaggcaggcagatcacagggtcaggagatcgagaccatcctggctaacacagtgaaaccccgtctctactaaaaaaagaaaaaaatacaaaaagttagccaggcgtggtggcaggcacctgtagtcccagctactcaggaggctgaggcaggagaattgcttgaatccaggaggcagaggttgcagtgagccaagatcgtgccactgcactccagcccgggagacagagtgagactccataaaaaaaaaaaaattgagtagtatattactttgctagggctgtcgtaacaaagtgctacagactgggcgtcttcaacaatgaaaatgtattgtctcacggttctggaggccagaagtcagagatcgaggtgtctgcagggtgggctcctgctgaggctgtgagggagtgctggctccaggcctccttcctgcatctggtggttttctggcaatctttggtgttcccaggtgcaccaatgcatctccagcctctgccttcgtcttcacatggtgctctccttgtgtgcatgtctgtctctgtgtccacattttccctgtttacaccgacaccagtcatttggataaggatcttttttaatgacctcattttaacttgatcacccctgcaaaggctccacctcccaataaagtccctttctaagtcctgaggataacgactccaacatgtcttttctaggagacacaattcaacacatagaaaacagttaagaaaaaaaagagaaaatttggtaattgtcttctgtacagacttctattaaaacaatgaaatgtttatttaccaaaatcaggaccaagttacaggccagtattaatatatgaaactgcttgcgtttcacatgtacacttaaatttccagtcctgattttcataccaagaaacatggccaagtcatcacttcataaaggaaaaccgttttggaaggtaaaaaagacaattactgtttgaaacagtctaacattgaactttagatgtaaactatgccgagcaaacattttttccaggtaacgttatttgttgcagacagcctttggccattgtgtagatcccaaatgtggtgaaatgggagctcccagatcattgcccagtttccagctgccatcccgagtttgttggtgtcactgattccaagaacaaaacactggtgcatgaaattaacaaccttataaatagatgacagcacgtctgttagacaaaaggctgcagttatcccctagaaacaatcaaacacaattccagtaaaagtcttgccaaatacctctttgtaattcaaggaacctaacaacagacaatatgcagtgcctccttgtttatgttctggaactcagcgctgctgcagtgtaactgagaacaggctagtacaacccacaggcatcttgaagtgtgcaaggaggctcagagaggtttatagcattgttgttttgttttgtttttcatggttctttatgtcattgtttgttttataaagtgttatttatagtatgttcatccttagggacttttccttgaaaccaccacctttaatgctgatgattggtgttcccatggaccttgggttaagggggccaaatggtatagatgccctggggagagcttgctattggcctttgggagagaccctgcagcagtaggtttcagctctcccagtggcagagctgggtgataactgcactttcttctaagggcgatacattttgggaatgtgcgtggtgtgagttttctgccagcatctttatagagcaatgtgtacttgcaaataaatacaaccaaagtcaacaaaagagcatattgatgctttggtagagaactcagcagtctcccctctctgtagcgtaaaatccagggaaaacaaaggccccacaatggggacagatggccccgcataggtctaaggactgccattccgttttaaagttataaagtactctcacactgtttacctcttttatttcacaaaaccaccgcattaagtggacagggtagaagatattatcctcactttttatatggagaaaacgtggctcaggtgacgaggtgaatatttgtgggtaaggcaagaactttctttctttctcagtcagttctctctactcaagtggacttctttttattattattattattattattattatcattatactttaagttctagggtacatgtgcacaacgtgcaggtttgttacatatgtatacatgttacatatgtatacatgttggtgtgctgcacccattaactcgtcatttacattaggtatatctcctaatgctatccctcccccagccccccaccccatgacaggccctggtgtgtgatgttccccaccctgtgtccaagtgttctcattgttcaattcccacctatgactgagaacatgcagtgtttgattttctgttcttgcgatagtttgctcagaatgatggtttccagcttcatctatgtcccttctaagctgaccccactccttcctttcatggtaggcacacatgcaccgagtaaaatggctgaatctgggctccaaaatgttctcttcagtcccgcatgttttggcaaactttcctctctgctgtggcacttcaatcccgctcttctccataaggtctatccttttcttcataaaactttctcatggatggctccagtcccaaataaagctatcctcctgctcctggcttactccaatttcccagctcttttgggaaatgtaaactttatggtgtcattattccttttatgtaacttccttttttcttttctgagatggagtctcactctgttgaccaggctggagtacagtggcacaatctcagctcactgcaacctctgcctcctgggttcaagcgattctcctgactcagcctcctgagtagctgggattacaggcacttgccaccgtgcccggctaatttttcgtattttttgtagacatggggtttcaccatgttggccaggctggtctcgaactcctgacctcaggtgatccacctgccttggcctccgaaagagctgggattacaggcgtgagccaccatgcccggcccttttatgtaatctcttatcctgtcccaaagacaattttataaaataataataagtagcacttttgggtgattaataggtgccaggcaccatgtcaaaaactttctgtccagtatctcctttaatcttcacaagaaacctattgtggtaactcttacaccattttatagatgatgaaaccaaggctaaaggaaatatgatgaaatgtccagggtcactcggctgggaatttgggaagccaagttggaaactcagatctactaattttcaaagcttgcacttattttaaagtaatggcatatttggtttgttgtcatagtttaatcatgaactgtttcaagtgtacagaaaagtacagatggcattacttaaaaccacttgcagccaggcgcagtggctcatgcctgtaatcccagcactttgggaggctgaggcaggtggatcacctgaggtcaggagtttgagaccagcctgaccaacatggagaaaccccatctctactaaaaatacaaaatttgccaggcgtggtggtacatgcctgtaatcccagctacttgggaggctgaggcaggagaatcgcttgaaccctggaggcggaggttgcggtgagccattggactccagcctgggcaacaagagcgaaactccatctcaagaaacaaaaacaaaaacaaaaaaccactcacatccagaatgctcaaatttaacaagtgtgatctgtcttgttgaatgcgtccagggtcttgaaggtgtgtatgtatgctgatgcacttggatgacctgttgtaaagtatgtcaattaggtcaaattagttgatattttgttccagtcttctatttaattacttttgctgtgaattactgtgtaagaagtattgaaatctctcattgtatttggagatttgtctagttctcttttcaaatctgtcacgttttgcttagtaaatattgaagctctcacagtaagcacatatacatttaggattttcttgtcttatcattgaattgaccttttcatcattatgaaatgtccctggtagtattcctttgtctctgttaatattctgtgttcttcagtccatttgtttgataataaaccattgcagctttcttttgattcatatttgcctggtagaactttttctatccttttacttctaacctcttcatatgtttacatttaaagtatgtttcttataaataacatgtagttaggtcttgctttttttttctttcagtgagacaatctctatcttttaaaaagaatatttagagaacagattagcaaattatggcccctgagcctaatttatcttagtgcctatttttgtaaataaagatttattggaaaacatccatgagcatttgttaggtattgtccaaggctgtttttgtacttccaaagtagttgcaatacagaccgtatggcttgaaaaaccaaaagcatttattatatgtccctttatggaaaatatgtgctgactcctattttaaatgttacatttgatgtaattgtcagcatgatttaattgaaatctaccatttgctattaggttggtgcaaaagtaattgtggttcttgccagtaaaagtaatacttgtttctttatgcttctctcttctgatttttggttcaatttttcctgtcctcttttggctacttgagtttcttattattccaatttattttcactgttggattaacaagctctttgttttactttttaatggttgatctatgtttacaatgggcatttttaagttatcacagtttatctttgattgatggaccacttttggtatatcgtgtaaaagcctacagcagtattcttccatcatttcaccataccatcctttctgatattttgttgttcatttcatttctacatatgtttaaatcccataatacattgttattatttgtagtttagaaaatcaactgtctttaagaaaaaaaacagctttatatttatctatttcttaattcttgtttgtttttgttttgttttgagatggagtctcgttctgttgcccaggctagagtgcaatggcacgatcttgtctcactgcaacctctgcctcccaggttcaggtgagtctcccgcctcagcctcccatttctcgagtagctgggattataggcacccaccatcatgcctggctaattttttgtgtgtgtgtttttgtagagacagggtttcaccatgttgaccagactggtctcgaactcctgacctcaggtgatctgtctgcctcggcctcccaaagttttgggattagaggtgtgagccagcatgcctggcctatttcttaattcttaatcctttttttttttttttgagacagggtcttactctgtcacccagcctggagtgcagtggtgcgatctctattcactgcaacctctgcctcccatcttaattcttttttatagaaacgaatttcctctggctttattttctttctgtctgaagaatttatttaacattgtaatgctggtctactggcaatgaattctctcaacttttgtttatctgaagaattatttcgctttcattttttaaagtttttttgctacataaagaatttcaggtggacattatttttctttcagtacttaactatatcattccttgtcttctggctagcttagtttctgaggggaactctattaccattctcatctttttttcctttgtgtatatgtttcttttctctcttgactcattcaagattttatctttatctttgattttcagcagtttgaatacaatgtgcatagatgtcattctctttgtatgtaatttgtttagagtttgtgaactttgcacatctgtttttggtagtcttccattcagccatgatttcttcatgtgtttcttctgtcccatcctctcttgtttttccttcggggtctactcttacatggatattcggccattttaatcattccaggctggctgtgtgcggtggttcatgcctgtaatcccagcactttgggaggccgaagtgggcagatcacctgaggtcaggagttcgagaccagcctggccaatgtggtgaaaccccatctctactaaaaatacaacaaaaattagccgagctaataatcccagctactcgggaggctgaggcaggagaattgcttgaaaccaggaggtggaggttgcaatgagccaagattgtgccactggactccagcctgggtgacgagagtgaaactctgtctcaaaaaaaaaaaaaaaaaaaaaaaaaaattatttcaggctctggactctctgttcttcttttatttacttatttactttttcttcttttctcataaatataatgttaagaagtagaagtcagacataaaagaataaaactatgatggttccatatctgcaaagtcaaaaaatgcccaactaatctatgaaaataaaagtcaggttcggatgtagggttagaatgtaatgattgataggtgcacgtgggatttcttagtgtctgataaagttctgtttcttgatttgcatggttgttagaccaggtgggttcactgcaaaacttcatggaactgtacacatgatttgtgtactttttctggacatgttattcttttacttaaaagtttattttaaaaatcaaaaatagctttccgtgtgtttttcttctaaaagtcatacattttgtttgggtccataatcttttcagaatgtatttttatttatactctggagaaggtaagtttatttttctcctacaataatagtcaactcttcatcatgaatgttgcatcatttcctggtagtttttatcataatcttggccatgtatgcacgatccttttctcgtctttctcttctgttctatttatctatccttacacaataccacacattagacattctatagctttatgacaaatctttgcacctgatatggtcagtcccttctaattctcttctttaaaaattgccttggctattatttgccttttactcttacatgtaaatcaggaaacagcttttaaattttattaaaaatcctattgaaatgatattgaattgagatactaagttggagagaattgactactttatgatgttgaattatcccatcctggaatatgctagataatataagcacaaagacttcttttaagtcttctaataaaatgttataatattcatcatagatgtcttaaatataatttagaataattacttctgcataattttaaaatagggtaaattagtgcttctttttaatcacacactttgcattgagtgttaccagtgaaaggaaatgctaaagactcattagtaggaatcttgtatatagtgaagttaccattttcttgctaagttcaaatggttggattctcttggatagtctatatggacatttgtaaacaatgacggttttgtttctccccgtccttgcctatctcttttgtttgtttgttttgtgtcttcctacactggctactcttttccatccaatgttagcccagaaaccatgacagcatgcactttagtcttcctcttaatttaaaatgaatatttccatattttcatgcctaagtgtgttttctgtatgctttggtatctcttttttttttttgagaagattaatatagatctcttctatcccttgttttaattttcatattttgaattataaatatgcactgtgttttcaaagaatttatttttctttgcatatagaggtgatcgtattgttcctttttgtttaatctactactataatgatttacctaaatgaaatgtccaatattaaaccaaccttgattatattcctaaaatacaccttatttaaatatgttattcttttttaaatatacattgacagatgtactttgagggtcctcatctttatttgtacatttttagtcagttttacgagcaagagggtatctgttccatctgagcttgatcctctgatgattcattaattccttttaaactactgtttcacttcctttaatggttatacttctattcaggtatatttcttcctgagtcaattctaagatttgtttagaaaattaccaattacatttaaatgttcaaaattatttaataaagttttgtatattttcatattatatttttctactaattacattttcattttctgtccttatagtgtttgtcccttttctgttttgatcttgatcaatttttatataattttgcatgttagtactattctcaaagacctatagtttggttttcattttctctttttatctttgcttaatctctcattagtacctactcttattgattgattccttctttctgctatctttgcatttaatctatttttaaatttttaagataaaatatggcacatttattttcagttttctatcctttctatgaaataatgggtacaaatttttctctattattttagctggatctgtgagtcttgatacggagtgttcattacattcaatgctaaatatttcatattttgcattataattttttactcatgtgttattttgtttccgaatatatgctttatttacccttttcacaaaaagttgttgattataataaattaggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactcttttgtgcctgtggtataatacactatcttatactctcaagcatttcaatacctcttccagtgtttctagatcactctgtctctctcattcacacacacatgcacatgcacacacatatacttttacacatgcatgcacacacatacatgagcacacacacatttacatacatgctcacacacagcacacagtgggacagtctgttcacaaacactacagaacaaacttccttgtctgtaggaagatatgtgtgcacctggcctctttgctgttcttacgacttgcccttcccaagttatttctactttacctctgtggttcgtttgatagaatttccagttaatgtattataagttataatatgccttttctggaataaatctttgctttcaatagatccattcactcctttccagaaatgatcgctgctttttatattctccttggaaaaacaaaagcacctgccttgacccttgtcttcaatatcacatataaccatacaaaactaaaaacaatccattcatttattcctttggttaatagatttttgttgggcagctatcatgttgtatgcggtgtgttagatgctgggtatgttctatgaaacaaaatagtctctgacccctggaagagaaagaaagaaagaatatccctcgccttacctttcttgacccatagtccaactgaagagagaagacgtctgttaattaactaacaatattaagtagcaaattctgagtaccaaatgagtggtattgagatcagctgcctatttgtgggctgatatggttccaaatggcttcacttgacagccttgaaattgagtcttgaaaagggtgcagaaatctaggtaaaaaatatcgatggggaggcatttcaggtgggagaaggaaatgaagaaagaccctgaggtgttacatggggtcaaaagaaaggatgattcaaagcaaggagagagcagagaagagttgggctgaaaattgaatttcctaccacttgtaggtaccaagttgtgacaatgagcttgtcatttcttgcagcacctgtcttatgtagctaaaagtctctttgagttctgcaatggcatattgcttctacggccaacattctgtctttgatagtgaggtcttacattagcattaaatcaaatgttatattgaaccttgagtaaaatctcttccaatttatgttttttttttattatttgtgtctgtgttgttctctgtgtgtgtgtgtgtgtgtgtgtgtgtgtgtgtgtgtgattgtgcacctgtatttgcgtttctcatctggaaaattctcttattcttttcccagggtttgcactgattttcacccttattcactcatctgaaatatcctttttcagtttaatcccagcattttatgtggtgctagactttggcttattggattgtaatttccaacttctaacctctcacctttgtaagacattgacactgaatcatctttcctcactctcagtataaatggtattttaactccaagctggctgcctgttaaattcatttactgtgctagagtgtatctggtaacttgcctgtgatgaatttgtgtccattattacattatagatggtttcatgcagccatctctgcaaagggcctaattatagctgtgatggccaaaactacttgttacctcgtgtcttctgactcatgtgacttgtacatgttttgacaatgaacagttctaccctccaccatggttagataaggtggaatctttttgataggagacctatattagttcagataaatgatgttgcttgttacgtacgaacacacatcactttatctcgttagcttgggaaatggatacgggcagagtgtattattcattttatatctagtgctgagagaggggcacttcacacaaaatagtggttcagcaaatgtttgtgggatgccaaaaaagcccccacaacaaaaagtggacctctttggttatccaagagagatgttttgtcttttggttctagaaattttttcttgcttcctcatctctcatagacatcctagaggagtgtgtgcatgtgtgtgtgtgtaatattaagcaaccagccattctttaccaatagaagatatccttgtttctaacaatgagacttcttctaatagtgctaacactttatctcatgtatgttatttattttttgaagatatagctttgcattttggaataattggagactcacatgcaattttaagaaataatacacaaagatcccatgtactctttgcccagcttcccctaaagttaacatcttgcacaactatagtacaatatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatactgattacaaaaacagcttgagtctgtgagcttgctgtcttgcccttctgccttcctccagagacccttgacagatgtgggccccttgatcttaagctttccagcctccagacctgcgagccaatagatctctgttcattacaaattactgagactgtgatatcctgttttagcagcacaaaaaggactaagacaccaccatagtcaagatacagagcagttctgtcatgaggacccctcgtgatactctgacagccacagccactccttccctccctaacccctgacaaccatcaatctattgaccgtctctaataatgtcatttcaagaatgttatataaacagatttataaaatatgtaaccttgtaagattggctttttctgtttagcataactcctgagatccacccaagctgttcatgtatccatagcgggttcctttttattgcggagtaatattccatggtattggtgtaacagtttaaccattcactcatttatggatatctgggtttattccagttttgggctattacaaaggaagcttctataaacattcaagtatggtatgtgagtgtaagttttcatttctctgggattcttgtctatgaattcaactgctgggttgcgtggtgattggaagtttagtttattaaagaaacagtcactgtttcccagaaagactatgccattttccattcccaccagcaatatgtgactcagtttccctctgtcctcatcaacatgtggtgttttcattatcttgtattttaggcattctaataggacttgtcttattgggcttattgtcttatttgggctactgtaacaaattaccatagactgagtagcttcacagaagtttatttttcacagttcaggggaaagtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctgaggtcgggagtttgaaaccagcctgaccaacatggtgaaaccccgtctctactgaaaatacaaaattagccaggcatggtggtgcatgcctgtaatcccagctactcgggaggctgaggcaggagaatcgcttgaacccaggaggcagaggttgtggtcagcagagatcgtgcaattgcactccagcctgggcaacaagagcgagactctgtctcaaaaaaaaaaaaaaaaaaaaaaaaaaaaaaaaaagtagatgaagcaagttgctcaaatcagacacttgtttgagtcacaaaataatcaatggtagagctttgtctgcaaccctacattactccctcattgttttatgttgtcctgattaaattgagcttctaactgataataaaatctattattcccaaaattgggccacccattccccaaacgtcctaccttcattctagaatgtcaaacacaagccacagctgagcagcaggacctccatcagcatgcaaccacatggccagccacgccctgcgccaagcctccagatggagaggatttggtgggaaatcatttctgctgctttccgcattccgcatacagtgtcttcttttaacatggcctcttgagagccactctccagcggcagcacggccagcctctgtgcctccactctccaccccaccttgcccatccacagctgtcttccctttctcttctctctttgcagctattctcccttcccaatccagcacagcagtgtggctctccttcctgtacactggtctcctattttcccttctctcatcacataaatcaggctcacatagggttagcttgcgttagcttcttttaactggttgttctgttggttttaattttcctatttttgggattggtttaattatgggaggagttagaggctattttaatgaaataattatggaattagcctaggttttttgaaagaaagaggaaggaaaggtgtgttccattctgtttgcattttttcttctgtatcaagctttgatgtagctttttttccaggcagaatttaggtgcaaatggaaaggtctcaatctgactcaagtcagagtactgtgtgtggttgttctcaatggtttattaggttttatagctctgttttcttttcttgacaaagttatctcacctttgcttgaaaaccatgtttctctgaactatttggtggtttcatgattgcttgtgcttaaattaatgtcagcagcaaggcaatcagtagaaacttcaagtttaaattctcctgaaagctaactttaaatgttaatgtttcatttaattgaagcattctgagatattagcattaaccatttagagcacttttattagataaacggaagaagggagaaggcctaattattgtaagtcatttctgttagacatttatagagaacttgcctttgatgagaaaattgcaaaagaggccaagtatgtcaaatgttgttgtcttccaattcccatttcaatgtgcaaactaatcattcacttccctcatgggaccgctgtgagtttaactgggcaaatacatgtggagtccatgggtgaatctttcattcagtgcaggctacgttgggcgctgtggtcagctggaggcccctatttgacaagagacggtcagaacttagtgtgtgttttctggggctgttttgattttcctgtacaggagagttttgcagggaggcatattgggctggaaatcaaaaggccgtggttcttgcccatctttatcatgggtagatttctggagccagaaccagagccaaataacttcctgacctgcaaaatgaggaggcctggaagattatcctaacgagcctctttgctctgtagttccagcaattatatgtattctgtgaaaagccaataacgtgcaattcctgatagtgaaataactctggagcccatgaactcatgcttcataggccagccctacagattaggaaatgggtttcttcctagggtttttattcaccgtacaatactttcacattttctttccaaatgactattaatcacatattgaattttaaaatattataatccattttccctccagtttttgtggaaaaaaatgtatacacataacgtttattattttaaccatccgtaagtaagtatacgattcagtggcattaaacacattcacaacgttgtataaccatcaccactatctatacacaaaactttttcatcacccgcaacagatcccaatgccttttcaacattaaatactgacttccccttcccactgttaccattcacaatgttgtgtaaccatcaccactatctatacacaaaactttttcatcatccacaacagaaactctgtccccgttaaatactaactcccctttcctactcttaccattcacaatgttgtgtaaccatcaccactatctatacacaaaactttttcatcatccacaacagaaaccctgtcctcattaaacactgactcccgcttcccactcttcccagccctggtaagtctccctctgcctgaattccccaggagtttgcctattccaggtacctcgtacagtgtctatctttctgcatctggtgtattgctcttagcataattactccccctccagttttaggagaagcttcttcccaaggagatttttgataagaacaggaggcggccagctcagcttcctgggatgatttgggtacagccccacccagatgtctctaatttggcgttatcagagtcagtcaccccactgaaaagcccgcctacccatgagcttgggaagccctacatttacaggatggtcagctgtccccatgcccaggagtggttctgtctggagctgattcacagctccatcccctagaaactgtaattcaacaggtcttgggtaagatttagggatctgcattctaaagacagattccattgatcccagtgccttttcaacagtgaacactgtcttctgcaaacagctcacaattgtccatgaaattttgagcttaaggaagttctaacgcccccctcccctcctttatttttgagttgaaagagggtagaatcaaaaacaatactgagaggggtctaaaaatgcaaacacagagagttgctggtttaggagggctgggaggctatgggagaccataggcatagagaaaacattccttctctgtgactctcgggcgcgagcgaatccccaagggggtcaccagagaatcatttcctctttgggaatacaacatgagatggttctttcatctggacctaggttcaattaagtaaatagagcaaatacaaataagagaagaaaagcagcacaaacagtgaaactaggtctttacatacctaaggaggagccgtgagcattcgcctccagggaaccacagtgacgggaaacatgctggaatgttaaacgttccatctcatttgtaggaagcagatgcctacatcttcaaattttgtcttcttaaaaatattattttatccagataaaaatctataacctctagcaaagaaaaaacaacagctgcaagttggagatcatgaactgtctttccaaagaatctccacgtgtagctgatgtcagatgccatcagcagtcagccttcatcaccccaacgccaagtatttgttcagtttctgctccatatgaatgcatcttggatagaatgtgtttggtttggcttttaagaaggctcactgacttagcccatgacctaaagcatatacttaccaagccttggaattcctacagagggccctgcactttgtgtttggtacagagaccaaaaatacaaacccagctttgaggacagaagggcagggaagcaggctctttatgctgtgagtctctcactccaccccatggtccactctggaagcagaagaagtttctttggggatataaaatgtattgttggcaattgtttttgtgtgcagttaaggatcctggaattacagcatctaatgttctaactctactgccatatccatcttaggaatagaaatgcaattgcaaatggcaatttgaggtaagcaatccgattgtgcgaataggtcatatcagatggccaggaatcaagggtcatctaatgagactcactgaccacaactgaaatcagccaccagactctattttctctctgacaattgtgatatggagcaaagaacttcacctcccaccaccatccctgcccgttggtgactgctcgtgaacatttggttgatggatggacaaatgtatgtgtgaacaaataaattaataaatatgtaagagtattggttactggagtatgtattactagagaaataagcaaagacctgctccatacccttcccccaagaaaatagcaaatcattctcagttggaagactaaagagaaatgctagagtccaggccaatggaaaacaagttaaagacagaaggtttagtagcactggaaaacccaggaggacaaagattctccaggtcatcgggaggcgtcgtgctttttttcatgggaaagaaaacttgacccagagtggcttcattaaagaagggagagggacttcataagtgaccagtcgagagctaggccataggggctgcagacccgggactcaaacgatgtgcaaaggcctcagtttctctcttggtctctcccacaatgctgtctgctcacacaggctttccccctttgcactgttgctggttgcattctcgctctttcccccataaggctattaaagttgctgctggaaggttccagagctgtatgatcccggaattgtaccctgtgaaaaagcatagctgcttttctcacagagtaaagaggtccagccctgagttattttgcccctaatgggtttccagggtcgtgtcctttcccaacccctgaggaagctcagcagagatgcttcaggatgagattaggctcactgagcgggtgaacggagctgtttgaactgaggtctcagggagaccagccctctaactgcagcgagctggatttcagacccttcctgtgcacacacactgttgcttgcccagacatgcttcccctttgtcttgttagaccattgatttcctttagaagatcaaaatcagggtgcaggtaggagccttagacaatttctagtttgactctcatcatatttttaatatagccctgcattttcctcatatgaaagcagaaacccacagagtttatgatgtgctcagagccacgcacaggatcgctagaagccggggccacagcccagcttccaccctcctgatggggaccatatccatgtgctgctcttacatgtactgaaaactcagcacatgcctactaaatgctctgtaggctttatctcattttaacttcacttactcatgtaatctcagcactattatcatctgcatgtcacagaggagggagctgagatgcagagtatgtttgtgacttgcccagagttacacactgatatggtttagctgtgtccccacccaaatctcatcttgaattgtagctcccattatccctacatgttgtaggagggacctggtaggaggtaactgaatcatgggggcaggtttttcccatgctgttctcgtgagagtaaatgagtcttacaagatctgatggttttataaagggcagttcccctccacacattctcctgcctgctgccatgtaagatgtgactttgctcctcatttgccttcagccatgatgatgaggcctccccagccatgtggaactgtgactccattaaacctcctttccttgtaaattacccggtctcaggtatatctttattagcagggtgagaacagactaatacgcacataccatcgattggcacagcataggcactccatgttcatgactccaaagggtaccatctaccacctgttaactgcctactagtatcttcaaatcaacgtaagcctcgtagcgttacctattgctgccttgtcctaagcaatcatgttaatggtatctaggttggatgagctacttatatcttttcaattatacaggaaaaacaatggaaaattgtgataatgaaaagaatgtttgctcacaaaccactgaagatggcttcacctgccaccagtgatatgtgaacacacttatgaaactctcacctatattacacagccagggaggctagtgtatttgtggctgatgagggatcaataagcttatagcataacaatacaggtaaaaatttgtgaaagagccctggtcaccttcagggatggaattgacagcagaaagcccacagcaccaaggttaagtactttgttttgtgtgtatttatgtgcagaaacatagatgtgtatatgtgtagatatacaaccacattatacgttatacttagaagtgcgggttgcatacgccactgcacattagaatcactatacagaatccagcaaatcagattctctgatggtggggcctcaacatcagtacttttttaaaaagtcccaggtgatgtctaagtggagccaggtttgcaaaccaggtacctaggatagaggttttcaactcttggtgtgctcacagagaagcacttgaagtatctgcacagctttgtcaaaatgcagattcaaagcctcaaagattctgatgcaggtaatctggggtggcccaggaatccgcacatttcacaagcacgttgaatgattctgatgcaagtgaagggtctgaggaccacgccttgaaagctctgcacagaccccagctcctctagaggacttgcattgccatctggtgaggactgaagacccacattagctaattacatcagtatttttaactctgggaaaatgtaaaaagaatttagcacccagtgtaaatatggaaagattctttcttaaatgttcagtagaggaccctgagcatatggtgactatatagtcagtagcgactgatcactttttaatgtcagtttcatcgtaatcatacggcttccgaatgccacacattaaaatgttaggtccttttcttcccaacccaggattaaaattcatctcaaaggcaaaacatactgtgatttctcaaatgtttttggaactgtcaaaaccagaggatatatttagaggcctttaatgtagaacacaaaatttcactacacgcagaattgccaattaggatgggaggctcagaaatgatcttaatgacacaagtgtgcagtgtttttttccttctgcattacatgaataatttcaagggtgttttcactctgaatgagttttttttcctccatttggcactgcctgtggagtcctctctatagcagaggtgatgttacgagctgtaacgacgtccccgtcagcaagtagcacatgcttttccattagttatacttccataccttcgtttgcagttttgtttttacatacaggattgaaacaaataccagatagtacttttccaaattgttttggtggactcctccccatccacagcggcagacaactcacattaaatatgaagctttcaccacatacaatcagaggcctatcaaaatagcttcaaacttcaaattaatgccattttaggatcactgatgcttttctttagaatgccatacacttgaaatcttctaagactacaagaactgtatggacatttatagctgaaaagaaaacctatttttagaactcagagctgaaaccctacctcaatactacccctatgttttcaagagttcctgtttcccaatgctagtcaactctgaacctgaattttaaaaattatttcctctctgtttcctccctatctgagaagtcatttatttgatggttttagcttctactggcaactacgacatgatttggaagcctgctaagaatgagtctataatatgtttatgtcatgtattaaaaatctccacggtcttataacttaatataaccctatgtgtaattagttgaccgagagtccttttcaacattgattttgatatatgatttctaatttatttgtttatttacttatttatttttgagacagaatctcactctgtcgcccaggctagagggcagtggtgcaatctcagctcactgcaacctccgcctcctgggttcaagcgattctcctgcctcagcctcccaagtagctgggattacaggctcatgccaccacacccagctaatttttgtatttttagtagagacggtttcgccatgttggccaggctggtcttgaacccctgacctcaggtgatccgcccaccttggcctcccaaagtgctaagattagaggcatgagctaccgcaccaggcctctaatttttaaggttttaattctaggccgtaattttttctcttccaacatgataaaaagggtcttcccatgcccttctcttggtttctcttccctcctcatgcctaccgtttatctgtttccatgacctccctgcccacctcaagtcaggtggcacttcaacctgctggcaaacagtgccacccaacactggcacatgagtccatagaatgtctgggaaaagaggcttgtcgtaccatgtgatgtaaagtactaactgtgcaaacgtgcggcactcaacaattttaggagctttgtgattccttcttaatgatgtgcttaatatatttcccccaatgattgcttattttctctggttttaccctcctttatcaggtccttattgaatttcttcttttcctagttaaactggaaaagtaacttattactctgccaggcagtaggatcactcaccaagagacggtaatgagggagaccacatagcccagttggtctggtgatgcctgttttcccaacatagttattaatagcaccactttcactttgccactttggatggcaaatgatatagcgacaatggcactacatttgctactggcagctcaagaagatgttacagaggctggttttgacggaatcacatatgccagatatgtggcatatgtggaaatagatgggaattatgctggaaataggtggaggcccaattgaccctgcttgctcctgtttacctgtagcctctgcttttctgcttcagcctggaattgtcacagaatatcccagacctcctagtctgtacagggtctggttggacaagacccactggctttttagaattactccggaagtcctggcttgctgatcagaagacttgattcttccagaaagaggtagccaaggagacagaaaacaagctggaatcagagcaagaaagactatgtctaccaaacatccccgtctcttcctactctaactgtagatacacgtggataccatagcagcatgaatgagaccaacaccatcgaatgaccattaaatgaatggtcattcgtttatggggaagcagtactgcagggattatgaggtcttatggtttaaagtacagcacacatggaccacggtcccagccagggcagcctgctgtgggaatctctctcagcagatttttgcctgttagattccagaaccttctctggtcactttcatccaatctaattgtctgtcttacccaagaagggatttgttacaagggacttggtggattaagctaaagcaatcttaaatgcagaatgccaggtttctgatacagataatcaatttcagttgctgcagaaaactctgttgggggtgatggagagaatgcactttgtggacccgtctggattgtctcctagtcttgtatccaggtggcactgagcctcatcagtggggtccactctgttatttcctggcctttacttggtgagataaacccttcatgttcagcagccttgtaacagtttgcagaaaagtctccagcctttgcttatgtgttgggtgcaagtctactgatacatcctgagggtgtatgctgttgccggtgcgttgcactaaatgcctgctactgaaaatatgcccagggaatatttctctttatatctgtggaactttgtccatcgctgtgctggaaacaaactattccctgggcagtcagtggtgcgcttttaattctggcctgtgtggtggcagtgggaggggcggtgccttttgctgcgtcgggaacctcttgatcccaccagggtgagctgaaagaccttgaatatgatacttcaaataataaaaatgtatgtgtcaccttggatctgcccagaaaaggggagaggattttacaaacacacacacacgcacacacgcaacacgcacacacacacgcacgcacacgcgcacacacacgctgacacacacgcacgtacacgcgcacacatgcgtgcacacacgcgcacacacgcgcacacacacgcacacacacacgcacatgcacacacagagtcattcaggaaaaacaacaacagaaaacaatttagcacatttttggtgctctgaaaatataaattgggattttatctaccaatattaccatttatcaagttataactatgtatagcatttaattgatataaatacacacagcataaacttaccccaaagtatttatgctttaaaaatttatttacaaataatctgggagaaaaaggtttatttcaaaactatatagagggctgggcatggtataatcccagcactttcggaggccaaggcaggtggatcacttgaggtgaggaattcgagaccagcctggccgacatggtgaaaccccatctctactaaaaatacaaaaattaggccgggtgtagtggctcacgccagtaatcccagcatttggagaggccaaggcgggtggatcatgagatcaggagttcaagaccagcctggccaaaatggtgaaaccctgtctctactaaaaatacaaaaatcagccagacgtggtggcgggtgcctataaatccagctacttgggaggctgaggcagagaattgcttgaacccgggaggcagaggttgcagtgagccaagatcacgtcactgcactccagccagggcgacagagtgagactccatcttaaaaaaaaaaaaaaaatcagcttggtgtggtggtaggtgcctataatcccagctactcagaaggctgaggcaggaaaatcacttgtacccaggagacagagattgcgccgctgccttccaacctgggcaacaagagtgaaactctgtctcaacaaacaaacaaacaaacaaaaaatatatgcagagaagagagtacttaggagcacagtgggagggtgagatgtcagggctcagcatctgcttccgaagttgtcaccaggcatttgttcagggcatgtgggcactaagaggatgaccccgtggtggtcaggtaccttgctgctctgcacacaaacaatagaaagcaatggagcccttgttagaaacacatatttctaagctccaagcctggagcctaggaaacagtgtctcccaggaagaaacctgttaatctgcaccatgtcagggaccccaccccaggattcttaccagtagtgatgggtgagaaacactggctatgctaacagaagcaggcacacagcggccccgtcttcctcccatctgtgagcatgcttcagggctgagcatatgaccaacattttacatttcagagttggctcccaccttaacacacacaacaatgtggacaccaccataaactgtgacatcaccatcacccggacaccagtgggatttatgttgtgtggattaatggccagtggataaatatacagcaataccaaggggcaggtcaacagcttaaagattaggagaaaacaatgagtcagaaactgagcaggtaatcatcagagcatccgtgaataatctgacagactcctcagtcttccacatgtgcacgtggggcagaatgttgacatccaagtgggcatggtaagcagctgatgaaaagttaaggatggaaactttaggcttgaaagtcagcaaagtgaagctgacttgccaagaataaactaagcagctatgtggcatcatgcagatacacacacagacacttttttttttttaagatagaaggagaaacagcaggagagggaagaagtggaaagaaagatgctgacttgactggactcttcactgctaacctttggtgaaggataagtttagacacaggctgcctacatgcaagcatagagatatttctagtgtgccttcttataaaggaagcacaggtagatgtttgtctttgtatggttgtaattaagcgccaaatgatgtcctccattcccttagtgacctaggaagagaaccagctgtgcagcaccatctctttgtctgtttttggaagtgagcccaatgcacttgaccctcagtgctatgagggaccagggggctgacaggtgaaatacagcagggaaggctgcaaagaagccccaagctgctgcgggcagggtgtgtgcaaggcgcacggtacagacagacccaccctgtgtttgtggggcaagccccctgtgcctttccccctctgttgcctctttcagctgccctcagtccttcccacaattcatcccatctcccagcacctgttttggatttggagccagtatatgcaggagagaaaaagaagacagtaaatcgagcaagaaaaaggaaaatgttgtattctggagcagaattacgaatgagtcagcagcaaggtctgacaaaacaaaatacaaaggcagtaaagtaggaggttggctgccaggctggtgtgaagctcggatacctgtttctcagtggccgccagtagaagacagggatatgacaagcttgggaagaaagcaggcatgctggtgtgcatcctggaaaattagttaggaggaaattctcatgggtttcttcctttgaatttcctcctagcaatgctatggctgatttcatttgtttcccagaagatgagctgaagacacataggagcagctattggaattgaaatgtccaagtggagactgaaggaaatatatattttgtaattactcagctatttctggatgtcacagatgtttttgaaacgcatatttggaaacacagttgaaatcacaagtgaaatttttattgttcatctcctaaatgtaagctttttattttatttagaggcatcctcggttttaatcatcttgttatacttagatgttctcctcttaacgactcattgcaaaaagaaggcattctatgtgaagggtacagagaatgcgagaaacattctctatcaatgacctgaacaactagggattgatcagaaaagaaggaactaaggtataatagcgttgggtgtggtatggaagtagaagtcgtttgagatacatatttgaagaagctacaggttcaagaagaactcaccatttctactctcttaaatgtaagttttgtgaaagaccagtgactactataagttagtttattccaggaggagagaaagagctgagatataaatactgaatcctaaggatttgtccattatttttgtgtttggaatctgacaactgtatgtcttctatattttaacccttgtataaatggttgcagtaaattgcctagagcagtgaaggaaagatgtgcagccaagggaaagatcaagaaccttcggtttacatggagctatttcctaatatttgttttatgtcatatgagctaaacatctttaccttttactaaatatttcaaattttatctggggtccattagaaattttttctttttttttttttttttttttttttttttttgagacagagtctcactctgtcaccaggctggagttcagtggctcaatcttggctcactgcaagctccgcctcccaggttcaagctattttcctgcctcagcctcccaaatagctggaactacaggcacccaccaccacgcctggctaattttttttccttttttttttttttttttttgagatggagtctcgctcgctctgtcgcccaagctggagtgcagtggcgcgatctcggcttactgcaagctctgcctcccgggttttcgccattatcctgccttagcctcccaagtagctgggactacaggcccctgccaccatgtccagctaatttttttttgtatttttagtagagacggggtttcaccatgttggccaggctggtctcgatctcttgacctcgtgatccacctgcctcggcctcccaaagtgctgggattacagacgtgagccaccacgcccggccttttttccttttaagtcattataacaagacgtttaacttcatgcaaatggtataaaatatattggcaaggagtgcagaaatgtttgccaaatatggtcattaatatgggggtgactacgacctgcttgagagaagagaagggaagacttctctagggaggactgattcattcaggaagttttccatcatccttcaacttccgcatcaggacttacagttcactggaccatcagccacaggagtgggcccagacaccagacaagaagtcagaagttttggcaagatgccgggtctttgggtgagtgcccagtgagaggtacaaatgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttaccactcggattgttcctttcttgctcatcctcccccatcgcaccttagaaagtgtgctaggcttcaggagactttcagagaacccactgggcccctccaagacggatgcatggccacaagagcctgttgtgtgccaaatgaaggttgcatccatggtcgcagcagtctgggtagtagagaaggacgcaaccagtcgaatatatcaaagccccaaatcagtccaagaaaacaaatttgaattttgtcttgggagtcttagggtggagacgcagagctattccctaaccctgagagtgaaattgattctcagtggaagccatagcattgcccactagaaaactttaatttttttttctttttttttgtagagatggggttttgccatgttgcccaggctggtcttgaacccctggcctcaagtgatcctcctgcctcggcctcccaaagtgctgggattataggcgtgagccaccatgcctggcctagaaaactgtagaaaaatgtctccatctgttggaaatgtatccactcatttgctgttatcaatgtcgatgtaaacatggcccagcctgaaagccaagggattgatttaattaattaattaatacttcccgaccatggagcagctgctgcctcagagatgggggatcagtcccatcagccccgctgaattagctgattcttgtcaccctctggatcaagaatcatggaaagaatggggtgggtggagaggaggagttaaaaaggaaaaagaaagaatcaaatgtgaaaggagatttttaaaaaccagacacagcagaggccatctaagtctaacatactcattccccccaaacagtatctctgtgagccaccctggccctctccctggtctcgccccagaaggaggccagtgcccccatcccagctttccatccctgagtccttcccccggaccagggcttgatttgtggataggagttgacggtttgctcaagaaggtgcattttcccactttggaaaacactgagtgtggaatgacgagctaggcctggccctgagaacaagtgttggccgcaaccagcagggaccactccggttcccacttggagaagctttggtctttccccagctctagaatggctttgggaagacgccggcgtggcctcaccaggccgccgcggctgtggttgctgtgcctgcctggctcaaatcccccactgcagccttctctgtgttttcaaactgcacgtgcgtggcacagtagagtgctacttttatttccgttttaaattaggtttttgtttttttttttttttgagatggtatgtcgctctgtcaccaggctggagtgcagtggcgcaatctcagctcactgcaacttctgactccctggttcaagtgactctcctgcctcagcctcccgagtagctgggattacaggcaagcgccaccacacccagctaattttttgcatttttagtagagacggagtttcaccatgttagctaggatggtcttgatctcctgacctcgtgatccgcccacctcagcctcccaaagtgctgggattacaggcgtgagccaccgcacctggcctaaattagttttaatactgaacttccaaccaggcagctatggaattcccaaagcaccatcaggtttctcagcacccagctccaggcccacagcccaactcctgggctgcctggggcatctctgaggccatgggccatcaggttcacaaagacatgcacgtggggggacctccatccccactggcctgaaaacatgctcctttccctcctgcctgacccaacccacccagaagcagtgatttaagggattgattgttttcgggaagcccctattaaaatcccctctgtcacagaagagcccggaaggacattttcagaagctcccttggtgctccctcctggtacacagctgcgtgttcgtagacgggcagctacgccgagacgggcgcctggtgagagcctggatgtgcccacggacaagggccaggccataaatcagggcagggctccaacctgcacctgcagacactgccccggggccaggcatggcctctgcagcagttggtcccagaggtcaggatttgagcagtaaataccagcttcccttattctcagccctgcttctaactgaggaccaactgggaaaagccagatacccacaaccaatctcctgggacgccctgcttctgagcgcctccagcttcccactccagcagcctccagccagagcatccctggagcctccttttctccaccgtgaagctcacccacccccccgtccgaacgcaggtaagagcagtgagccccttgctggagaaagctctggataagcagcctctgctcacactcattttagtacagtcttagccttagcggccatagtgaagtcccatagactgggggcttaaatagtaggacttgatttctcacagttctagagcccagaagtctaagatcatggggccagcacactcggttcctggtgagggttctctccctggtttactattgatcgtcttctccctctgtctgcacgtggcagagtgagaaggagcgagagggagcaagagcatgagaagagacttctctgatgtttcttcttacaaggcacaaatcccatcatgggggacacacacttatgacctcttctaaccctaatcacttcccagatgctccatctctagccatcacaccggggcttagggcttcaacagtgaatttggggaaacataacattcagtctgtcacaggtggtctttgtttattttcacactggcattccagggagaaaataggtgttcttttatttcagagaagagttgctgaggggcctctggggactctgaggccagggaaggagggaggcagaggaggcggacagagcctcaggagactgacctccctgctggggctccccaggggtccagacaggcagacgggcagccttccagggctgctcccgaaggcctggcttcccctctgcaaaccacaagctccaaaatggtcattctccatctgaactcagccagtgacactatacagatagggaatctgaagcccagagaaggcaaggaagttgtccaaaaccacgcaggaaacagtcacagtcctgcattccttccgcccttttttcctgctgtgttttcttcaatgataaactcacaagtcctggcctcagggccccgggagtagtagccagctgcctttctccacagagctgggctgggggtgtctagcatggtcccttggggtgctcgtcctcacccgtgtgggtgccccaagcacagtctccagccaacatggagcctggctcagtggacatgggcgtcaagatccaggctctgagaaaaccacagagctatgggtccttccaattcctatccagccagggatcctttctagaaattctcttttttttttccaactttttttattttatttttaattattatactttaagttctagggtacatgtgcacaacgtgcaggtttgttacataggtatacatgtgccatgttggtgtgctgcacccattaacttgtcatttacgttaggtatatctcctaatgctctcctttccccagccccccaccccacgacaggccccggtgtgtgatgttccccaccctttgcccacgtgttctcattgttcagttcccacctatgagtgagaacatgcggtgtttggttttctgtccttgcaatattttgctcagaatgatggtttccagctgcatccatgtccctacaaaggacatgaactagaaatcctcactgatcggcttaccggcccccgatgcacagccataaggtagctctgtgttgattcccagagtgggatcggaagtggccacaagttcaaggagacacgtaaacacacagaagagccgggtcagccacccgactctgtaacctccccccgggagaaagtgcgtgccacacgctcagcatgggcctggcccaccgtgggtgtgccagcaatgaacacactgccgccttgcccaccccaagtaaagggaaccccagaaagccgcaatctttgtctgttttgttcactgcagaagcctcaacacatagaaccatgttcacgatcagagggaaggggagggtcccacctgggtcacatcacggtctggaggtctgcaagaaacaggtggatgctgggggtgaccagagccgccgtgtctgcggttccctcggtgggaatgtgctctgtgcgtccgccgggctggctcagaagctcacggaagccctttcaacactgtgcagagccaggtggacaataaaatgtttgggaaagaggagaaccgttttcaaaatgatatgaatatatttaaatccattaaaatgtttcatttgacttacattcgtttatcttcaacctcttcatgagctcagtgagtcgagttctgttagcttccatgtgtaaaccacaagcataggtacggtagtataaaaacctaaacgtcaggaatggaacagggcccgaaagaccgtcatgaagccatctgaatgggagtcctttccgagttctccatgtattcctagtcatttacagttgcccacaacttatttcaactccttttttttagcagattgcccctactgaatttttccaaatcactcaacttcgtttttctaggaatgacaccattttgtttttacactcactgtccagagtttaagtgggattgaatccaatttggctccgtggataccactgtgctccacccagcacccctctcagagcagggtgggactctgcaggacaggacactgtggcccagctcctgagcatgtgggctgagctgttcacagctgggcccttggctagcctaccggacctgcaggggacctgcctggttgaaggtcacagaccctcccaggagcgccacctggccaaggaccgtgtgacttgggataccaatacccagtccctctgtctcaatttaggacaatctcaaaggttatcccagccacagaggcttcagctcaagggcgacgtcctgggggacaggctgaggccgacaggctcagcctcagccccccggtgcgtctccctagggcactaccagtgaacctgcatgaggcagcggtccctcagagagtctgtttctagggatcctaatcgaacctatgactggagtgagaagtacaactacaaaggaaatgaaacaaaacaggtgtgggcgcaaacccaacagacgctcggcgagcccagcggcactcacctctgggggatgcaggcttccacctggaggcgaagaccagaccggccgaccaccctgagtgtgggcagtccatgtgctacacagagggatggagccgcagcagacagcctgcaccctgctttcataatgtcagtcagggaactgctaccacccagactagacacggcccacctggaacccctctgttgacctgcaggggattcgcttgggggcagctcagctcctcccatgcctctgccatggaccccaggtactgcctgctggcctggtgggacctttgctccaaagccgagtgactaatgcagaagcgtggaggacccactgccagcatcctctgaacaaagaagctgctccctccctcccagccttggccctagcatgggaagttcctaagttggaggagtctggagctccctggctttgactttggttatcataactaatggctttccagacagaggccagccccacccatgagctggttattcgtctaatgtggtttgtgtcagcctggtgggaacgtgtgctggcagcttcagcagcctccacagtcagttctagggttcacaggacctgcttggtgaggaagatggtggcacgaggcagaaacagcaacgtctttgtggttgtgaggcctgagaccacatgttcctatcagctgtgtaacatcgggcaggtcccttcatttctctgagccccaactttctcatccttaaaatagaacaagtacctgcctctttagggtgttgtacaaattaaacattgtctgataaagtcctttgttaacctgtgtgctacatgagtgtggggtatgaccactgtaagtttcattactgttagggttaggaaggaactacatcagtcccttgtaggaattacttttgtagccgtggacgtgggttaacagagccacgcgcttgtcttcagaacatgtacgggtctcaaccctgaggctgtgcccttgtaggaaggctggccttcatcacagggccccccagcccgggaggacccaggaagctatttttgagagacttgggtctgcaggtctgactccaggacaagtcgaggttaacaaagttagaatgagaagcagcttcccagagggcagctgaggcctcgcaggaggcctgtgtcagaacgtccactttaattaaaatatttgcctgcctgtagcctgatttcttttacacatggtctaatttcttatagtggacctaagtgactctcacacaccaccctgcaaggcaaggcaagagtttttaatttgaagtttcgaccattagggaaattcatggatgggcttcagggggtctatgagtccctgaaattgcaagccaaagttgtgtgtccctgcacgtctaataccatcctggtggcaccaagaattgccacctggaaacacaagccattcatgccgaagggctttgggcctcatggactaaactcccttacaaatctcactcaatgagacagcttctggcctggaagagtcatcgaggcacctccagacgatgtgagaatctcactgagttttctttctctttctctagaaaagggctattaacaaatttgagacgttgatagaagactttcatactcagccaagtagcagccatgaacctcagcccaaggagaatgcgttgactgcattttcacctttgttactactggagtctcagaacatccttgggaaggacatgaggcaagtaacataactattccaatttcactgataaggaaggtgcacaaaatttaaatgatttgcccagaggatgtagctggtttttacttcaaccagctctaaaaccctaattcccagccaaaggcttttccattggaaggaaaagggaaaatttttcatttcccaaattagttatcccagtagatcaagagacccttcaggagacctaaagtcaacttgtgaagattcacagtgttaatttctgcttgtctgaacttccacagtgatgaatggagccacagccagtcgtgctaagctgattaaatacgcactttgctagccacccaccatgatgccaactctacccgctttttttagtattcctgtcgtgtggagtccactcccacatggaatcaggcttgacccctgtgactacagaatactgcagaggtgacagtgcgtgaatgccaaggcttggtcattaacggtactgcagcttctgtctttctctcctggccagatggctccttctgtgggaagttggccaccatgttgcaaggatgttcaagcagctccacggagaggtccatgttgagaggaactgaggcctcccaccagcagccagtgcaattctccagccatgtaggggcgccaccatggcagtaaatcctccatcctctgtcagtcccacccatgactatggccacagctgacatctgattgcaacctcaagagagactctcagacagaattcttggccaaggcactctcagattccaaatctaaaggaactgtgagcaatcgtaaatgactgttgttttaagccattaagttttggagtgatttgtcacacagcattcgataactaatacaactcacaaccacccccaaaaactctgccagcacccgcatcagtgcctctgcaggacacccctttctgtaaatatgggataggctggggcataagtgacccttgagagtgggcgcagactctgaaccgtctgacataagtcactggttcctagtcccaagcatcaaatccctgctacattgggaagggttcacaaatggcaggaagagaaatggtagaaaaattccttcaggcactaactggagtccaccctagcactaccacccctctttcttagaagtggaacccccagtttttaactgggcctatggtcatccagaataaaaactgttccggcctcttcgctgagcctaacttctggccactgggatgtatgtgacatgccacatggcagctgccaagacacttcctcaaaagacagcagggaagcatccttggtctcatcttctccctcctccctctgggttcctgaagacccaacagagccttggtccacaaggtggaagctccgagccaagggtgacagagagcaagcagatgctgcctgggctcctggcaggtgggcacactataccagccctggtgtccctcatcagaacgctctatcttctttatcttggccttttctgtgttttgcagtcaaatttgatgccagctagcacactgcactgtgagggctgaattacacaggccagcggcttgatcctagggcccagagcctctcactgcaaaacgctgtgtagttgccagttattcaggacaactaagcatttgcattggacacaaggcagatgactatgcatccattcactccaaagatcacaatagccacattaataataataattaacatttatgaaaagcctgctctatatcaagcactgtgctagcattctgcgtggataaacacatttaatctctgcacaattaacacatttcaatctacaactaccccatgaggttgggttaccattatttacgtttggcggacaggaaacaaaaggaacagagagacgccgtcactggccccagataacaaagccagtcagtgctcgggagggagtcctgccaccaccagctccctctccaaagggaggcccttaccaggtcccaaacccgagtctacccacgtttgggcacagcagatgaactgtgtgacctccatgtgtttgagtaataggcttggccttggcaggttgatttgtttgagctgaaagagaacaaagaaaggccttctgcccaggtgcctggagaggtgagcaggggtcgctggtctgcgagaggctctccagcaggagctgaagaactcgttttctgggagacaaagggagggctggcttggcctgggaggctgggggcactctctgtggcccagagggagcgccatgcagtcggtccagagaagctctgagatctggggccacctgggcagcccagggtctgcagcagcctcctgccagtcaccacggctggaacctgggggctgtggagggctccgaggtggaggatggtcccatgtgtctgggtgagcagcagacaccacgggagcagctgtttgacctgagccagtcacacaaaggagtcaatttccagctgtgtgggagcctgagtccaggcacacttggcaaggagcccttggtggccagcgtcctagcctgagatggcagggggcaaagctggtgaaacgtaggtcgtcagtggtggtgagacccactctcacccagaggccggcaaggtcagtgagcaagattatccactgtagttcgttcaatcggatttcactgccagtattccctgtggagaagagtggtataatcaacataatttttttttttttttgagacggagtctcgctctgttgcccaggctggagtgcagtggtgcaatcttggctcactgtgacctccacctcctgggttcaagtgatcctcctgcctcagcctcccgagtagctggaactacagatgtgcgccaccacacctggctaatttttatatttttatagagacgggctttcaccatgttggccaggctggtctcgaactcctgacctcaagtgatcctcccgcctcggcctcccaaagtgctgggattacaggcgtgagccaccaagcccagctcataagtatataaatatgatgaattcattgaccagtagagaagcaggacccatgaatgtctccaaattctgttttcaactgcaccaagactgctggagttttacgtctcagatatattagcagatgtgtgcttttccaaataaccatttttacggaaatcttaatattgtctgaaagtcagcatgattgtcctgtgaatgagatttttactcgcttggcggaaggaggcagaatgaatccactgcttgagatcctcttctatgactgcagcaactgtgggctttgaggaccttgagctggacttagatgaccctctcagtggtatgctggcatcagccttcctaatagaaaacaaaaggagagaaaaacaaaagaaaagaaaatcccaacccatagagtctgtcgatctccgtggtgtaagtgtttccactatggccaacgtcaaacacccaagctgccatcactgaaaatggagttgggaagcaaagggccaaaccccttcccgcccatttccagtgagtaggtgtgacactctccatcaggcaccactaactctggctaacaccggttagtctatggggcagggcctctaggagggccaaagaatgcagcaccaggagttgacaaacccacaccctccatcctggacaggtttcttctgtggcattgggcaggcacttccacaaatcgaaactgactttttcccacccaaatgacaagttcccggggtaagcgagacggtttatttcccccatacctcacccctccgtcccccatcaacagcgcctggctcacgtggcagttctgagcaactggagagacgtggacagaatgaattgcaagaggatgtggggggtcctagctccatgttgggcgggaccaccccgcatttccatgctcctggaatcccaccctgaagctgagctccacacccctgcttctagagcactttcagagaccgcagcctcaaggaggtctactgattcagtaaccggcagaggctgtctggggagcacggtggaagttaaacgccatgaagagagcatccaaggcccccagactctggggtcaggagtctcacaccaccacgctgctggctcaggcataatttatcaggcttcatacatatcagaggaggccgcagctgctagcactccacgccagccctgcaaacatttcttcaattattcagtcaccaggcacagggagctagtccactgcttcaaagttacattgttataaagtaacaattacagcaaggtttagggctgagctcccaggcctggacactccgccccacaaccctgaccaccccagtctttctctctctctctctccagtcgtctctctctttctctcctctctctctgtccattctctctgtctctgtccccatctttcttctccccttctccctctctttctctctcctcttttgtcttttccccatctctccctccctccggccttgtatccttccttgtctctccccgttgcctcccctcctcttccctccccatctgggtgggtggtcaggccttggttaggcttggccatccagagaggaggggaagcctggtcgagcacccagcactgagcagagcagacagacttggcgaaggaggtgggagcagggatcaggagggagggtgcagggatgcccctgctgtaacaaagcatcccaaacccgagacttcaataacggggttttatcctatgctgctggagactgagctccgagatcaaggtgtgggcagggccaggctccctctgagagtgctagggaagggcctgtcctccgacactgtgctctcccccaggggatggggcggggggctccctggattgtggctgggtctctccacactctccgtggcactctccctctgtgcgagtctgtctctgtgtcccaattcccccttttcataaggacagcagtcatatggagttagcgcccaccctgctgaccgcatttcaacttgatcacctctggtcagaccctgtcttcaaggaaggttccatttggcggtgccatgggttagggctcagcagatgttttgaggaataccaccattccagcacaacagcagggcctcctgggtgggaggaggaaggagcagctggggcgggagggcctgtgtctctgaggcagcttgcggctatggggtaggtggccccgtgagtggacttgggacagggccttgctgtgtctttggtcctcctaggaaaggcctcctggactctccggggctctgcccttcccgattgtcagcagtgctacggcctggtctgcagggtcagcctctcatgcctgccatacctgggcttttttttttttttttttttgagatggagtctctctctgtcacccaggctggagtgcagtggtgtgatctcggcttactgcaacctccacctccctggttcaagcaattcccctgcctcagcctcccgaggagctgggattacacgcaaacgccaccaagcccggctaatatttttgttttttgtgctagagatggggtttcaccatgttggtcatgagaggtaacaacgtgctagcagcccttgctagctctcggcacctcctcggcctcctcggcctcggcgtccactctggcgcacttgaggagcccgtcagcccccggctgcactgaaggagcccctctctgggctggccgggccggagccggctccctctgcttgcggggaggtgtggagggagagcgcgggcgggaacctgggctgcaagcagcactcatgggccagcgcgagttctgggtgggccctccactcagagcaaccagctggtgccgctggctgggcagtgaggggcttagcacccgggccagcagcagcagcagagggtgcgccggatcccccagcactaccggcccgcccgcactgcgctcaaattcttgctgggccttagctgcctcccctcggggcagggctggggacctgcagcccgtcatgcccgagcctccccgcctccacccctgtgggtggagcctcccctaccggcaccaccccctgctctgcgggcccggtcccatcgactgcccaagggctgagaggtgtgggcgccctgcgtgggactggcgggcagctccacccgcggccccagcacgggatccactaggcgaagccagctgggcttctgagttcagtggggacttggagaacttttatgtctagctggaggattgtaaatgcagcaatcagcactctgtctagttcaaggattgtaaatgcaccaatcagcactctgtgtctagctcaaggtctgtaaatgcaccaatcagcaccctgtaaaaacagaccaatcagctcaatgtaaaatggaccaatcagcaggatgagggtggggtcagattagggaataaaagcaggctgccccagccagcagcggtcatctccttgggtccccatgaggtgggagcacgtggagccccatgagctccccccatggagggaggagcagggctgcggtgtggagcctgcagtggctggagctcctgtcctgcagagtcagggatgagacgtcttcccctccttcctggcctcaggcacactggtgtctctccagtcccaccacagtcctggctccaggtcttgccaactcctccccagcagcctcaaggggctgcttctgatgtaacggcttctgcagggcgtcgcatcctcccagctcctgctgagccctccctgctcccacctcctgggctgcactcctcagcctgctctctcaggcctccaggacctggggaagacatccacagtttacagggcacttcctcagaaacctaattaacagtgtcacatgggtgctttagttttgttttacactggggtgtaaacaacaagctgggtgcggtgcctcacacctgtaatcccagcactttgggagaccgaggcaggcggattgcctgaggtcaggagtttgagatcagtctggctgtgtctggaattggtgggttcttggtcttgctggcttcaagaaaagccgtggagcctcgcggtgagtgttacagttcttaaagatggtgtgtccagagtttgttccttctgatgttgtgtccggagttttttccttctggtgggttcgtggtcttgctgacttcaggagtgaagctgcagaccttcgcagtgagtgttacagctcttaaaggcggtgcatccggagttgttagttccttccggtgggttcatggtctcgctggtttcaggagtgaagctgcagaccttcgtggtgttacagctcataaaggcagcgtggacccaaagggtgagcagcagcaagatttattgtaaagagtgatagaagaaagcttccacagctgcaccagtgcctcccctgcagctcaggtcctactcccggaaccagcttcatggctgcccatcagaccccaaagcaggttcccctgagtgtagccgatcttttctcatgatcattgttaagtagaggcaccgtgttgaacagcagttctctcgattcccggcaccagcttcatgactgcccatcagaccctgaagcaggtgctcctgagtgcagccgatcttttctcatgattattgttaagtagaggcaccgtgttgaacagcagatctctggaacctactcatcgtgcataacgtgtattctacccccgcttcccctcctccagtcctggagaccccaaccctcctctctgcttctatgagcgtgactgtttcagattccttgtagatgggagaccatgcagtgtctgcctttctccttacttcacataacataatgtcctctgggttcatccctgctgtcactaatgatagggtttcctctttttcatggctgaatagtactccatggtgtggtgatggcctggactctattcattcatttgttgatggacatggaggttgcttccactacttggctattgtgaatagtgctgcaatgaacttggggtgcagacacctcttcaaaatactgacttcaattttttgggtcaatacccagaactgggatggctgggtggcaggtagttctatttttagatgtttgaggaaactccacagcattccccatggtggctgccctggcccacattcccaccgacagtgcccacaaggcacacctgatcccactcttccgcacgctttccccatctggaccctcttcacacccctgatctctggcagaggaggggactgggttgggggtccgccttcccccactcactctctttgtgacttcagcaaccacctcggcctcccaccctgttcttccccttagcaacacgaaggcttgggcgagagagtggcgaacgccatttcccactctaccggttcgggttcctatgcttttccccggccctgagagacagcactgccaccctttccactcctgcagggagatctgccacacgaagtaggacggatgtgaagcaaacaggcgacagggtcacctgccctcccagacagccttccacagcagggaggacggaggagagagggaggggcacaccctggaggctggggaaggtctcattcctggttggcaaactctcctcttcatgcccaccctgcatgactcctcccaggccgctaccagttcacaccccagcatctgtgcccggcccagccctgggcactgagcacagtatggcagcacccagcacacagaagccgggcccctgcacagctggattccagtggggacagaacgacaatacatatgagaaatctattgcccgagagggcgcctcgcacagagggagagcagagcatgaggaggggctgggctggggtggaggcatcgttctcatggaggtggcatgggagccctgcttagaaactggagtctacacaaagccctggggagtgggggaatgcgtggtgcagatgcctgcgaagggggctccaggcagaggaaccccaagttcatggcccaaagggagtgcctccccagcacaaccccagaatgccagagagccctgtgtggccagagtggggcggaggcacagggagaggctctatctgtccatccatcctgctgggcgggtgcccctcagaggccacagggccacaacgtctcctggctctgtgcacacccaccactgttgcctgttgtctcaaggggccagcacagaaccacccctgtccctgtggacttgcccagatggacgagtgcttggcacccacaacaggcagacagcaggacccaggtctagcagtgtggtcagagaatgtctctgccccttctcaacacaggccagactccatctccagcctgtgcaccatccctgcagcccaggaggagctcatgctggcatcagcatccccacacccacattccttttggcccaggccccactgcagagctcggactgctagaccctggattagccacccagtcaggaactgtccctgtgaactttataaaattcatcagggctgaggggaggaagagaaaggaaaatagaccaagctgcagcacactcagcatgaatcactgggtcagcctgctctgcaaccccttcctcattgccgtttgctgcctctcaccccagaatcacataaagcctggcacagattacagatgccttgaactgctctatagacaagttgaacattatgaaatgttaagttttgtttacatttctctgagatatcctttcaattcctgtgtaccagtgcaactactgatgccagctggtctgaaggactccataaaaagctgagtccccaccagagaatgcagtttccacctcctgatgacttcaccctcctcaccctgaccaatcaaccatcccagttttccagtacctcaccctccttaacaaccccagcccagaactccccagggagatggatttgagggtctcctcccatctcctcacctggagccctgccgccactaaactctttctctgctgcaaaccctgctgtcttggtgcattggcttgcgactgcacggggggctatgacctggtggccttgtaacagtcagtcctgaacttcagccctatcctgtagtttggcccaagatccctgtggtgtccagcctccaagctggtgccctgagatccccctcctggtgctcacccttgtggaggccccttccacaatgcacaagggctggttggtgtgaccagcagtgaccgcatgtcaatgctgagctaagaggaggtaataagagactgtggcttctaaggctggtgcttggtctttccccgctctcctctctttctctccatctctcctttccttttctttctcccagtctctgtctctcctctctctgtgtgtctatgtctgcctgaatgtctctctctgtctcatcactaactctggggaaacccagctgccactcaagcagaggcccctgagcagcctgtcttgcagagccctgagatggctgcagtccctgctgagagcctgactgcaaactcccaagagagcctgggccagagccacgcaatcaagcctcagccagattcctggccctcagacactgggagataatcagtgtggtgttaagcttctaagtattggggttgtatgttacacagcagtaggtaactaatacaatcccagatgctagtcacctgcctcccctaacacacaggagaccgcctgtctggacagcctcattggccccatggattcccttggcctggcccagaaagctgccctcaggagctgtagaactgagatccttctgcagggccctgtgggcctgagcacatccttgaggctccagttctccctcaaaccccagcccaggggtcacataggcaaccaaaggtctttactttaaattttagaaaattgctaactgcagctcaatgaccagcaggacagcggcttgatatcagataatggaatctgagcagcagctgatgttaatctgattgttcccgacagcctgggcagggccagagagacaggcttcaggtccccgcaccttttgtctgcaacacagggtcaagttttgttcttgtcatcgggccatgtcttccagtgtcatcagctcagcacttcatgttcagcatgtaatgacatttgtttttcttgctaattgctcttggagtggtttccatttccccaactagactgaaatcttgttaccccagaaacagtgtctttctgtgagtctcacacagaaaggagtggacggtgggctgcctctctgttctaccctgtattgtccctaaccagctgtccaccagagcacgatgaccacagataaatgacctgccatgtgacatcaagttgctagattcaccagcaaccagtcactcacccgtttcctgagtatagatctctggctaacgactccaccttgcacactacaagaatgtggagcaggctgggcacggtgctcacacctgtaatcccagcactttgggaggctgaggcagatggatcaactgaggtcaagagtttgagaccagcctggccaacatgatgacaccccatctctactaaaaatataaaaaattagctgggcgtggttgcaggtgcctgtaatcccagttactcgggaggcagaagtgggagaattgcttgaacctgggaggcggaggttgcagtgagccgagatcgtgccattgcactctagcctgggcgacagagcaaaactccatctcaaaaaaaaaaaaaaaaaaaaagaacgtggagcaatgaccataaagagtgaagctgacactgagaagtgctggcatccccctccgtaggccaggtgcggttcatcagcaccctcgggtctgagcttttgagctgaggcctttccaagcctcaagggagcagatggtagaagaaaaaaaatgttaaatccccaagctggaggaaagtgggtttgccaagaaaaatccttccaaaattgtgtctccaatacgaccgtgttgtctttgacagcagagacgtttttgtacagcttccctcctatttaggaacagctgacgtgaactcgacatcggaaatataaaatcagcagggaagtgggtctgaatcacgggaaagttagttttttcaagtgccaaggacaattgaaagcacatgcttttcaatttgtcgactggtacaaattggtttttggcacaaacagaaatgtgaccaatttctacagctgcgaaaacgacctctgtgcagcaggacggagacaggggcagctggcgtccttgggtgggctctgagccccgttcatccctgagactctcctccccgctcatgtggccccttctctcagccctgcagcggcctctccccacccggcattgctctctgtccgccaactcacgtttcttgaacagtctttggaaaacatttctgggcagtggaaggggtgtatctcttcccaattattcaagaaccagctctgtgaccctggacaggtcgctggaacctcttgggcttcagccaatgggaaatgagatggttggccagagggtccccaagaccccaaacctgtgaaacccagaccaggcgatgtggccacaggttcccaagcagcggaaactcttagatcggcctccgcgtctgagaacagagcgcagcggaactgccgcgtggccagcacctgggcctcccccggagctgctcaggagtgcagagttcaggccttgccccctgctgaacttgaactggactggccctgggaggccactcctcaggccttcaacctgtcatctgagagccgccagcagatggcagcaaaggcccagctctggcaggtctctgaggcctcccggctgggccgggccctggtacctggaggaagattgcacgctctgggactgcgagttgcaaaggtaccatgaggagccccgggaggtgaaaacacttcccgggctaacgtggcgccgagagggactgcggacccactcttggcttcctctttagaggagagatggagcggggtccgaagcgcacaggcttcgaaggaactagtgagccagccgagggcagcgggagccgcagaaatcagctcggagagagtcgcgtgcaggctgcaggtgtagggagagccggggtcaggctccggtgcgccgcgggggatggcggaccctccgggggccgtgctccccgcattcccaccacggcgcaggcatcgggtgccctgctcatcgcccctccagccggggccgggcctgcctctggaagccccacgggttctctggggcctttggttccagcgggacccaggagagcagcagcttttgtccgtgtgggccacggtgaccttcccagacacaaaatcaatgcctaggaattgcggagtgacccatcagcacacgtagaaagggtggcatttgtgacttttgtgcagctcgctcaggtgacacgaagtcagctccgagccctgcccagccccagccgtctcctcccagcagcttccagggctgcagccactgcaagaagccaaaggggaacccgtccccccggggggcctggggaccagcaagacgaggcgggtaaatgggcttcgcgggcggccgcaggcaaagccagggaggatctcacatcctcgtcagctcggcagcagcaacacagcaccgcgggccagtgggctcagcagcgggcgtctgcgtttcccagtcctggcggccacagcccgagatctgggtgtgggcagggctgcttctgcctggggcctctctcctcagctgagctgccgtcttctccccgtgccctcacctgactgtccccgcgtgcacggctgtatcctcatcttctcttcttggaaggacaccagtcctgctggatcagggcccacccacatgacctcattataccttactggccgccgtagagaccccagctccacataaagccacattctgaggtcctgggagttcgaccggcagcttatgaatctggaggacacaattgattcagcccgcaaccatcgcggaggctttgcttggggcacagctggcagagtgtgagtcacccagcgccagcaccacacggtggtggtcgggggtagcacccggggctccaggcgcagggagcccagctgcagtgcgggtgctgctgagagctggagaacgctggggagacacgcggcccgggcttcccgggcctggctggctgcactgccccccacacccgggggtctgacttagcaggtcttaggggtgtccaagaacctacttttaaccagtccctaggtaccttaagaccaggaggaggatttggaagatcccgctttgtgctaatttcatctaatccttgccataggcctattagaggtaagaaaacagagctacagaggttgaagaaaaattctcaagatcacattaaaagtacatttaccattcaaacctagggtcatgtggcttcagagcccttgttctgaaacccgtgccggcattccatttctagaccagggtggtgagcaccaaagccccagagaacccaagggggttccagaagcaggcccagccctgggtggagaggcggtgccaggatgcctgacactgcacaacctcagcccaggacacctgcagcccagcacacctgacacccacacaacctagcccaggacacctgatgtccacaacctagcccagcacacctgacactcctgcaacctcagcccaggacacctgcagctcaggacacctgactcccacacaacctcagcctagcacacctgacaccatatgccctcagcccaggacacctgcagcccagcacacccgacagtaccctacctcagagtagaggtgatgttcagagcactaacagcttcggggcacaacccgctggggctgcccacattgggctggaacagccccctccaagctcccccatgtcaggtatttggctcccctggtgccggatgatgaggtgatattagtgggcggggacacccaagagaggggctcatgcagcgctactacaaactcgtgtgggaggatttccatatttcagtatttttaccacaaatcagggctccacagtgccggctgctgactctgccattcttagatcaaacttctaggctcttagtgcaataaaatacaagtgacagaagtgtccccagagatcccccgcagtgtgcggctggggttacaagtggatcccaagtctcctcatccccaaagtgccatttgaccaggggtacccctcacagcagcctgcagcttcccttttcctctcctccatccttagctttcccaggccaccccttcccagcaccaatccacaaaaccacgtgttgcccaggtccccgtgtcttggctcaataggtgactccaaaacaaaagcgttgcatctttaaaagtgccatcatttcctgtccgtgtgtgctggcaagactggcttggaggctgggatcagggcctgggaacagatgggccgagtggggggcaggcaggggcaggcggggaatgcccagcaagaacaggggacgcctacgtaagaggaaagctgtcctgggcgccccaggagagtcccggctcggggccctgcatgtcgccggcagagagagaaggccggtgggtgggaagtgtcacctgagccccctgctctgtccacaggcccaagtaaaaggagacccagcaccacctgccataactcacagtggctaagggcgcgatgttggagcctgtgcctggggtagaccctggtcatgctactgaaacctctgtgctctgccctcctctgctgtggaagggaggaagtgacagcacctgtcttctgttggcattctgaggataaagtgggtgtgtatatgcacaggacttagctcaggatcgggcatgggcaagcacagtgcaagcacctgtcctaactgtgcactgtttcccatcattactatttaattattattactctcattcctctccttggctaatggggtgtgacggctggaacgggaaccaggtgcatgcatcggacgagaagcgcacttggactggcctctgtgtctgatggtgaattggtgtttctgaggttcaacctctggatagtgcttctgtgcactaaccagtctccacaagcctagtaaccaatcttcagatgactagtaaccagtctccagatgactagtaactgattgtaaccaattgccagatggctagtaaccaatcttcagatgatcagtaaccagatcatgactagtagccaatctccagatgactactaaccagtctccagatgactgataactaaccagtctccagatggctagtaaccagtctccgaatgacttgtaaccagtctccagacggctagtagccagtctccagatgactattaactaatcttcagatgactagtaattaatcagtctccaaactagtaacccactgccagatgacgagtaaccagtctccaaatgactagtaccctggtctccaaatggctagtaaccaatttccagatgactagtaaccagtctccagatggctaataaccagtttcccgatgactagtaaccaatctccagatgactagtaactggtctccagatggctccccaagagaccacaccttcagtgtcatgcgtgggacgctcccccaacactgagctgcctgtccttgtgtcaccagtagcaccatggtggcgacacatgtcacttcagagactcagtgatcagaaggcttgaagtacccaccttggtgtctgggaatgcacagtccagcccacgctgaagagagaagtgggcagagcaacgctggtcagcccccagccctttccgtcagtgcagccccagccgacatggggaagggctagctcacatcttccagcccaggagacagggatggcctggagaggtcatgggaccctgtggggccatctcagtcacctccagccagggaagccacgctccgctggggcgggagagttgtggaacaggctcaggcagcccctgctgtgcccctcccacaggatcctgagcacagtgaaatggtccttgttttagggaattgagttttggagtgtgtgttccctacctagctatatatatcccaaaaatatcctggtgttcaggccaccgtgcccaatggaagagggcaagcccttcatatgtgtatggctggaaaaggactctcatcgatttcccttttgaatttggagccctcaaaatcatctttggagaaaggcatagtcctgtctcccacgcacacatccttaactttggcaaataaacctcctgaaatgattgagacttgtctcgtcacttttctcagttgacaccctcaaggactctaactggggctgttaatggtcaacctaagatcatcaaaaggcttgggatccagttaaaagagcttactcaggtgtaaagtgtgagggcagctgtccgggacacacgaacactgaataatgttcaccagtgctcctggagtcgggaaaggtaaagatcgtttatacagggaaaacacaggtgaattacattttccatggaaaggctgacacaaagatataagatttagttggctactattgcttacactctccaggattgcttaacattccattgtgaagaggtaacaatcacaaggctctctcccaacatcatttaatctaggtgtgaatgaagaatgaggagggcaaaaatcacctggtgagcatcatgcagaccccagggacaaaagttccttatctgaggaatttagaagtaattagacttccctattacctaaaggcacctggttccaggcctctcctcaaaacgtgtgagtaactagaatttctatacatctctggaatgcatgcatgccaaaacttatggtgcaacccttgctgacactgagacaccaaaatgtctacaaatgtaatactttatcgtgcaaatcacccttcagctcctgcttgaaggtccataaatacccctaaggaaaaatccaccgcagtgtgctcagtcctctctagctgaggcacccactgcgctctccagccgcgttctttctttctaacaaaactttcctttggccgggtgcggtggctcatgcctgtaatcccagcattttgggaggctgaggcgggtggatcacgaggtcaggagatcaagaccagcctggccaacatggtgaaaccccgcctctacgcaaaatgcaaaaattagccaggcgtggtggcgcatgcctgtaatcccagctactcaggctgaggcaggagaatcacttgaacccgggaggcagtggatgcagtgagcagagatcacgccactacactccagcctgggtgacagagcaagactccgtctcaaaaagaaaaaaagtttttcctttttcaaacctatgctgttgttggtaaattcttaccaacctacgagttgaccacttcccgatgccaggcattttgcctggcaaagaacaggagcctggctaatgtgtcacatctcaacacaccaaggtcagacagctacagttgtgccccagagaagaaacacagctgttacatgacttggtttccagggcgttaactttaccccttggcaaaatacatttagaagctcctgaaacttattttattttcacatttctccctttccttgaaaattattcagagaaagcatttgttttagtctatttgtattactataaaggaatacttgaggctgggtaattaataaagagaagaggtttatgtggctcacggttctgcagactgtacagtaagcatagtgccaatgtctgcttcctgagggcctcaggaaatttctcctcgtggcagacagggaaggggagctggcacatcatgtggcaagagaggaggcaagagagggaggaggaggtgccaggttcttttgaaaaaccagttctctggggaactcttgagggaacctatagagcaagaactcactcattacctagaggacaccaaaccattcctgaggactccacccccatgactcaaccaccttccagaaggccccacctccagcattagggatcaaatctcaacttgagatttgcaggggacaaacgtccaaaccgtattagtattgcagaggaatcgtgctcaggccctgtattttatcaaatcccacattgccaggagggctcattcctcggaagtcacctccccaggaagggggactggaagggaccaaggtgaaatgtcaaaggaacaaagggagagtagtcctggagcctgggtcaggctgcacagctgcctcttcaatcacagcaattgtctgaacaatcatggttctagttttctcagctgcatgttgactcagttgcagacgaacaccgtagtacttctgtggacgaggacaggacgaaacccaccatgacgctgattcccaggatgagcagtcgcttttgccagcaagttcaccaagagccaaaacaactacttagccaatcccagaaggagggttttcgatcggaaagtctggttatttgggttatatgagttatgaatttgtgagggttatttgattcatctgacatgaatgagatgaaggcacgacattcagttttcatgacaggacacacttctcctcgggccacgctgagtatgtctcaggccacatggctctgtaatacagcctttctcatgacagccacttcatgatttaataacaaaatacccatgcagctgtcacttagggtctttcgtgcacaacttgttagggcctttatgtgccaaatgacaacttcaacacccagctgtggtaggacgacagaagccaaatgaccacaccaatggaacacagaacacacccaacaagattgtaaatgaggaaattttactggttttgacagggtatgaacgacacagccttgtgcccaagcataaccagggcaacatcatccttaccgtcctgggggaaacaatggccatatgttagtgccacatagccaagatgttccatttgggtctataaccaataaatacctgtccttgtgtttaatcggtggcagaccaatcagttcttcgtaagacaagggtgcgggcatacctcattttttatgtctaccccatatctctagcgcagttgggccattatctttggtgtgattttttttgttcctaacacaaagggggatgctgcctaagctggccataagaggagatgagcccaggtgaggtggcttacacctgtaaccccagtactttgggaggccaaggtgggtggatcatctaaggtcaggggtttgagaccagcctggccagcatggtgaatgcccgtctctactaaaaaaaatatataaaaaaaaagagctgggcgtggtggcacgtgcctgtagtcccagctactcaggaggctgaggcaggagaattgcttgaacctgggaggtggaggttgcagtgagccgagatcgcaccactgcacaaaaacctggatgacagagcaaggctccatctgaagaaaaaaaaaaagaggaggtgagctaagtaaacccaccccaaatttgtaatataccgtgctgaaatcgtgctgtcaattaggtatcattgttttccctttcatttggggtggggcctgaggaaaagccaataaactggtttcttctaccaagaagctcttctcatgttcctcattctgtaaagcatcatcaataggtcaatggtgtaccttatccttagtcagactagtgtgaaggacaccagactgattttgtgtcccatccgatagttttgataaatttttgacattctgtccagtcttgcctttggaaaagaaaagcccaccatggtaggccagacccactggaaagggaccacatatccagcaagcgtcattttgtaatctaccagcacagcctgggacccattgcaaaaacaggctgatagtcatgccgtcacataaggactaaggatactagaaggaagttcagtggaagcttataaaagaaaatcttctccatagattaacaacttagtattaaatgtttgtctagcattttgggtttcagctgtctatgtcaaatgccatctttttctctgcctggcatcaactattttgagtcagaggtcaccttctggggaaaaagtccaacctagagtctcagcctttgatatggtttgaatttgtgtccccacctaaatctcatgtccaagtataatccccaatgttggaggagggacctggtgggaggtgattggatcatggtgacggagttcatccttgctgttctgtgatggtgactgagttctcacaagatctggttgtttaaaagtgtgtagcactgccatgcagggtggctcacacctataatcccagcatttggggaggccaaggtgggcagatcacctgaggtaaggagttcgagaccagcctgaccaacatggtgaaaccctgtccctactaaaaatgcaaaaatcagctgggcatggtggcacacacctgtaatcccagctacttgggaagctgaggcaggagagtcacttgaacccgggaggaggaggctgtggtgagctgaggtcatgccactgcactccagcctgggcaacagagcaagactccatctcataaaaagaagtgtgtagcacctccctgtgttctcttcctcctgctggccatgtaagacatgcctgcttcccctttgccttccactgtgattgaaagtttcctgaggcctccccagccatgcttcctgtacagcctgcagaaccaagagccaattaaacctcttttccttacaaattacccagtatcaagttgttcttcatagcaatgcaagaacgaactaatagtcttctttagatgagaagtgttaactgccttctacttcagcagcacaaagtttagcaggcagtactcaataaggtctataccattttggttgaagagagttatttaagaaatgttgtgtccaatagatgaaatctcgtgggtcaagtccatggtctttgaagttttcttctcccaggagctcactgtgaaaagattcttctaccgattcataatttttagttaattgcctcattaagccattgcaatagctaaatatgtctcctttactattaaaggctatagatctgcctgctgtaatttttaatggagataactggtgtttaccaaaagggatcgacctcagattaagcagaaacagtggaagagcttttagccaaggaatttgaaagacctccattaattttgccagttgagctttgattattctgtttgtgtggtccactaacccagatgactgggggtggtcaacacaatggaaatactggagaatgggccaaatttaacgtactggttggatgacttatccagtgatcccagtgtctctgtcattatgaagctccagaggaactccccaggctgcaataatgttttctaagagaattgtactcaccctaaggtcattgctcttctacatagaaacacctgcacccaatgagaaaacatgccaatcattaccaaaatatatgtgtatatttgtgagagcggcaactggacggaatgtaattgccatactttgacagaggcctccctggattattttgggggcaaaggtaacaactgtacatcctgtgtgctacagtcagagaaggtttccaaaatatcgtttccctcaagcaatcactctgtcaggctctggggagttatgtcatgtgcataagttagaaatgataacaaaaattcagcatgaagtagaagcatgttgtttgatccatatcatacctcgtctttgggggagtatgttccccctctttgctttccaacttttatgttctggttttggagcccagattgaggtaattttatacaaatgcaggtgtttcttttaagattactgtagattatttttcttgtttagatacatttacagtagctctttttactaccttattagctagctgatttcctttgctttctggagtgtttgatttagaatggcctggaattttaattatggccagtgactttggtaataatatggctcccaacaattgtgaaatgaggtgtccattttttatggattgaccagaagaggtgaaaaatcctctgtttccatagcattccaaaatcatgagctactctgaaagcatatttactgaatattagtaatgaatattatcaacaattattcctttcgccaactgacaaaccctgatcaatgcaattctgcttgttgatgtgaggtggcttctggaaggtaagcctttctatttcttcagttgaagatactgttgtgtaacctgctcggtaagtccctgatccatcctttaaataagagctgcctgtaactcaaacaacatcagcattaatcagtggagtctcttgcaagtcagtcctaggaaagaggagccaatcaactggggctatgtgattatgcagtgtttcatctgaaaatgaaggcagaagagtgtcaggatttaggttacacctggagatggtgataggagaagctgaaagaagtaaaactcatgtgaagctcgtctactaattgaataatgtccagtgtggtgtgagtttagtgatgcttccacagaatgagggataaaaacagtaaggggagttcccaccacagttccttgggtcatcttaatgaacaaggtggttgctgttatatctctcatgcaaagaggcaatcctttggctaccgggcctaactgttggctgtaatgccctacaggtctatttcagccttcatgtttctgagtcagattatctaaagcatttccatcattttcatgtacaaacaatgaaaatgtgaggttataatttacatgccccaaagaagaggcattggcaagaccattcttagtcatttctaatgttagttgactttcttttatccagtctagagggtttaaagttctctattaagagggcatataaggaaggtgggcgcagtggctcatgcctgtaatcccaggactttgggaggccaagatgggtggatcaatgaaggtcgggagttcaagactagcctggccaacatggtgaaaccccgtctcaagtaaaaatacaaaaattagccaagtgagactctgtcttaaaaacaaaaaggagggcatataaggattgggcttttaaataaaaatttggaatccaatttctacaatatcctgccagtcctaaaatcccactcaaccatctcttcattcttggttgtaaaaagctgagatcctttctagtctgtctgaattaataaaacatccttccttggatattaggtggcctaagtatatcacttgtcttcgacaaaattgaagtttctctttagagactttgttttcttagggctgccttttgtaataaatgtagcccatcattcacagaacatcttgtttgctctccaagatggaagtcatttatttactggattaatgtatgcatttccaggaaattaacatctgagaggcctatttttaatatttttgaaaagtaagtcaggctttcagcatatccttggaggcctgtgtgacccagtgtattgtctgttttcccaagtgaaggcaaagagaaattggctatttttgtctacaagaatgctaaagaatgtactacataagtctatgactgtaaggaattccacattagaaggaatggctgtgagtaacataggcttgtgcagtatagggtgccatgggattgccatgttgtttattgctctcaagtcttgtacaaacctccattctctaacatttggttttcttaccaggaggattggggtattacaatggcttgtacaaggaatgaacagtcatctttctatataatctgacattataagctttatccctcctagagctttagttctcaaggggtattgtcttgtattttgaagatgtttccatgggtatatttaaatatttattggagtagctgagatgatagtttctatatcaatggaggacactgaccacaatggatcaagtactgtctttagtacattttgtaattcttcattaagcaataattcattgtctttcatggcaatatggattgcaattggattagattttgaaaattttattaaaatatctgttgtgtctcaaagttgagttttataatctaattttaaatatatttccttcctttgagagaaagaaatgtgggtatcacataattctaagcagtttcttcctgttgaatggatggggtctgatggaacaaagaggagggcatgagttccttgtaacgaacactgttgaaaggttacaggctgagattggtatgccaatacaggaggattgtgatgcccaccatttgaattctttgtttactgcaaggaatgggaccttgtaccaagatgggattaattccagataatgtggctccagtgtcaataagtgcttgtgttagttctccatttataataatttttatttctcccagtgttagtaaggaggaaatgaaaggcccctttaagttccttggagcacccctgttttcttttctgcctccactggttaacattctttcctttttcatttttggcaactcttttgaaagtaatcatgctttttgcaaaaattgcaaagtggaaggttaggtccattagggagtttctaggggtattgtgaaggccaaaattgtgtgaatagttgttttaattgtaaattcataattgtattagcctcgctcttttgtttggcttccctctctctttcttcttcagttaaggtatcagataaccggtcaatgagactgaccaaatcatgagtatcagaagtggcccaactttgtcttttcattgttagttccaattcatctaactcatttgttaaactggagtcgagtatcatttcgatgattagcacagctttcttcggataaaactaaatattctttaaaattttttccacagccctcaaagtatattactgactcatctgaattttgttgatattgtattttgttccagttgactactctgaaaaactgaggagatagcctgatgcaaagcctttgctgttcttcaagcctgtctatggtcctcttctgaacatttatgaagatccctaacagatttctccagtgagctttgtctagccagcctttagctttaatttttgctactaacatgtgaatctgttgctagaagtcagaataactagggtcataagcttggatatttaattcaaatttcctagcaaaaccaataggaacctggtgaagatcaaggaattcttttaactatgcctgtaagtttgatcatgattgataaagcaggttcccctctaccagatgctggatgaaatggagccaaaccagtgggagcaggaggaggggcaggaggaggaggaggagaaggtcaatcagggctgggtagttctgacaaggaggcttagagagacaggggagcagggagagaagaagacatttcagtgttttttaaaattcagtaatggttttagagtgctttttattttcttcctctaagggaagaattctgtcaaaacctcttttggatgcttctgggtgccattggaagtaactctcttaattattttatttgattccatagctggctttttaaaattgtgcatataaataaactaatctagctatttcaaagataattctctttgatcattgtaatttaggatcttcttaggtcaaataagaccatttctccaactatcgacaggaggtggcgccataagtcttgtacataaaccccgctggagtttccaaaggtgcattgcttaatgagggcttggttatagatggataattgctcataatttggattctcttttaaaatgcccaaaggctaaaagggaaaagtgtttggggtccagtgtgctgcttagtagggattattcctggaggtatcacctacaagtagcttcttccctcttacctacctcagagaaacccagacatttctgggagttcaaggcactgggtgacgaaccccttgtgtgttgtgtgccccgggggttaagcagctctccctgtgagttcttctctggggtttgttgtgagcttccacacccttgtgttacctccattgcctaaggtgcctttcagctgggagaaagagtcctttttgtcttcagcttatcacgtcctcattccaaccttttacaaattttgggtgactcaggaagaaactttaaatctcaatgttaaccaagatccaaagcctggctggtttaaagccacaaatttggcttaagccacaaacattcactttctccttttacaaagaaaactgctttctctttaaccaaatgtcaaatgagagaaaaggttacaaacttgagcaagtaaaaaaatgtccaatgagagaaaaggttacaaacttgagcaagtaaaatgtccaatgagagaaaaggttacaaaagagcaagtaagacgaacgaaaacttaacctaatagaaaagtgaaaccacaaacctgccaatagcagaatctttagagaaatgacgcgaaactcctgccttaaagccctaaatggcggcttcaatatcagtcccactgagcatgaaattcatttacttaaataaaatctgaatctcagcccaaacctgggagattcaaaacctgagagcggtcttaccaaagacgcccgtatgtctggtgaagtcagttggatgcaagcagtttgtgctggtaccagggccccagctactgatgaagtggcaggagtccacagaagcctacttcgaagttcccggggcttccaggggaggtgagaacacaagtgatgggagagcctggggagggactgtctggtgagtaaaggttgtgctgctctgtggatgaaatgtctctgaggtcgtaaacatctcagagccgccttcgggagaacgggtgatagtcatctgggctgatgtcacctccagtgtcctctcctgtgatctgtgttaatcctcccagattgacgagattcctggggaggcgattcatgacagctgagttccttttggaggatccgtcttcaggcaggtaaggggagctcagaggaaacctctgcctgcatccgctgattcccaagtgccctcagctcacagggatcagcactcccaagtgccatgggggtggcatttcctgaactccttcaaagcaataacaacaggctgggcgtggtggcttacgcctgtaatcccagcactttaggaggctgaagtgtgaggattgcttgaagccaggagttcaagaccagcctgggcaacatagggaaaccctgtctctacaaagaattaaaagaaaacttagccaggaatggcagtgcacacatgtggccccgcctactcgggagactgaggtgggaggagtgcttgagccaggtggttgaggctgcagggagctgtgattgcaccactgcactccagcctgggcaacagagtgagactctatctcaaaacaaacaaacaacaacaacaaaagtgaaacaataacaacaacttttacaaaacggacatttgggatctacatgccacactcctaaatgcgtctcttaagcaacaggtgtcacagtcttaaaccttgtccttaccctcttcattctaggcacctgtttcattccaggtagggcttcctcctggtttcctaacacagcgggttgagatgaacagcagagaaggacactgcacacctctgcagggtctcccctctggcccaccagccctcccttctccagcagtgaagacctcactatgtcatccaggcaggaataatatagacagaaaccccagaagccccaaagctctgaagcctaaaccacaagccccacgaagttccacagggcccactgggcagaatggcgtgaaccttcagggtttgtttggttttatgaaccatttagtcattctttctccttcctcccatggtagcactaaaatacattctcaggctcccaggtatatacaggggggacggagaggcgaggatattcctgattggaaaacaaaacaaaacctacctttactaatctcaatatacagattaggctaatcagattaaataattctgaaagttttcaaaatgtcattgttagatttttcattattttagagaagaggtcttactctgttgcccaagctggactcaaactcctgggctcaagcgaacctcctgcctcagcctcctgagtagctggactacaggtgcgcaccaccatgcctggctgaaattggtttttattgagggtcttgatatgaaaaaaaagtctttgaatcttaatgttactttttcatttcttcttggcaaccaaagcatccatgttttaatttttctttgtttattgttggctggagagcactgccttcctcatgtaccatgcatcaagccctctccccagcctgaagaacaccatgttcctcttagcgatcatcagtaacaaggcgtgccactcgaagaactacaaagataagggtttggggtttgtgctggggaaagctcatgacactagctgcaggaatagaggactgagcctcccaagtcctggaaagcagagggaggatgccccgctctgatttcctcagcacctttgcagagctcttggtctcctgcctgtgccctgcaggcctgactcaccttcctctctgcacgtgagactctgcacacctcctatcgtgtttattgacgcatggcagcctcagccctccatttcatgtgacctcccagctttgctctctacaacacctaacccagtcagtttctgtgtcctaattcaaaattgctgggagaaaaaaaagtctgattggcatttgagtttgagaacgaaggcttgaaagagccagtttgaagaatgggagcaaggcctggctagagcactgatcgacaaacttttcctgtaaagggctgggtagtagatattgcaggctttgcaggccatgaaatccacgctgcattgtagtggcatgcaagctgccatagccaatctgtaaatgaatgagtgtggctgggtcgcattagcattttatttccaaaaatagcaggtggccagatttggcccagggactataattttccaattcctgagatactagaaacagaagtgttttgttgttgttttaactaactctttattgaagtacagcaaacaaaagtatacacattatagcattgtatgaactatcacagagtgactacacgcatgtaaccaccaactgtgtgaagaaaacattgcctgcatcccagaaactatgtatgcacccttactagtcactaatctcacactcctccccaaaagtaactaaaactctgatttgtattgtcagtggtttctcctgttttggactttatataaatgaagtcatattgtatgtatttctactttctgtctaacttctttgtatgatattctcccagtggaattcatctgtattgtggtttgtaccaatggttcatttctttttattgttattataatattttattgcattactataatagtatttatttcattctactgtagatggacatttaacattgtttctagtttggggctgctgcatgtctttggatgaatatgtgtacacatttttgttggaaatagaattgctggtccaacatagatagatagataggtaggtagatacatagatagatagatagatttattattgaatatatataacaaaatgttcttattgttcatcataatttccaaatgacattttttttctatttggtgtggaataactttcatatcttccattaatttttttagacatagttcttttatttgaacatgtttttgatacctggtttaatgtctttgtctaataagtccaacatctgggcttactctgggacaatttcttttgactacttttttatgtttataggccatacttgcctgttcttttgtgtgtctcctaattatttggttgaaaactagacactttaaataatatatcgactctggaaattagagttgttgctgtttttgtgattgctgttgtggtggtggtttatttgtttagtgatgtttctggattggtattgtaaagtctgtattcttttttgtgtgcagccactaaagtatttacttggttagcttagtggtcagctaatgattggacagagaattccttaaatgccttcaaccaataagcctccccttgctcatgggctgtttgttagggtatgtcttcaatgtccctgcaattcacaactccaccttagtcttcactcctgcttgatcagaccctcaagagccactggagtaagtacttagggccttcctggtctctcttgggcctgcatgcagccgtgcacacaggaggccttctaatcccccaggaataagttggagcttttcaaagcccctaagaatatctctgtccctagactttccttgtaagttttatatccaatttcttttttctttcttttttttttttttttttgagacggtgtctcgctctgtcacccaggctggagtgcagtggcacgatcttggctcactgtaagctccacctcctgggttcacgccattctcctgcctcagcctcccgagtagctgggaccacatgtgcccaccaccacgcctggctaattttttgtatttttagtagagacagggtttcaccattttagccaggatggtctcgaactcctgaccttgtgatcctcccgccttggcctcccaaagtgctgggattacaggtgtgagccaccatgcccggccttttatatccaatttcttatctgccctaagtggcaccaccacttttgacagctgggatgttgaacagttagtgctgattgattttcacaaacaccctggggatggggctttcctcactgggagatctgaatcaggtcaaataaaggtgagccttgtgaatggggcttgaataggagctgccagcccaggagaaagattgatgattctctgggaatgaggtttttggggctctgaagctgtcctgcccctctagtccgtccattaggctgttggttttcactactaccacagttccaaggctgctgtttttcaaggctgctgcagagctgatggtggttgagggggtgggactggggaagaggcaaagttaaaattccacaaagcctgctgtttactgagtttcagccattttctttaactaacactctgaattgttccaatcctattgttaatatccagagttctgaaaaagtggattttgacagcttatgctacgtcccttctcttacggaggcacagattcttggagggccctccaccatcagttcacacatccttctccaggcattatggctggtggtttttattttttaccatggtaaattttaaatcttttctaggccaaatttttttttagtatgataaaagacacagaaaaaaaagcatacacacacacacagtaacacacatacacagaggtacattggcctattatttaattctatatgtggatgttgggttttgtgttagtctgttctcatgctgttgtaaagaactgccaaagactgggtaatttataaatgaaagaggtttaattgactgacagttcaacagggcttgggaggcctcaggaaacttacaatcatggtggaaggtgaagcaaatatgtccttcttcacatggcagcaggaaggggaagcatcgagcaaagagggaacagccccttataaaaccatcacatctcatgagaactcactcaatattatgagaacagcatgggggtaactgctcccatgattcaattacttccaactgggtccctcccccaacatgtggggattacaattcaagatgagatttgggtggggacacagacccagaccatattatacacactggcccctctcaaatcttgtctttctcacatttcaaaacacaattatgtcttcccagtgatttcccaaactcttcagtcatttcagcgttaaccccaaagcccaagtccatagtatcttctgagacaaggcaagtcccttccacctatgagcctgtaaaatcaaaagcaagttagttacgtcctagataaatgcgggtacaagcattgggtaaatacgcctgttccaaatggaagaaattggccaaaatgaaggggctacaggccccatgcaactctgaaatcaaatagggcagtcatcaaaccttaatgcaccaaaatgatctcttttgactccaggtcttacatacaggtcacgctgatgcaagaggtaggctcccacagccttgggcagctctgcccctgtggttttgcagggtacagccccccaccccccgccagctgctttcacggcaggctttgagtgtctttggcttttccaggtgcatggtgcaagctatcagtggatctaccattctggggtctggaggatggtgaccctcttctcacagctccactaggcaatgcctcagtggggatgctgtgtgggggctctgaccccacatttcccttcagcactgccctagcagaggttctccatgagggctccacccctgcagcagacttctgcctggacatccaggcgtttccatacatactctgaaatctaggtgaaggtccccaaacctcaattcttgtctaatgcacacctgagggactaacaccatgtggaagctgccaaagcttggggcttcaccctctgaagcaattgcctgagcatgtatcttggccccttttagccgcagctagagctgaagcagctgggatgcattgcaactagtcctcaggatgcgcacagcaggggggccctggacctggcccatgaaaccatttttgcctcctagacctccaggcctgtgataggaggggctgctgcaaaggtctctgacatcccccagagacattttccccattgtcttggtgattaacatttggctcctcgttacttatgcaaatttctgcaactggcttaaatttctccccagaaaatgagtttttcttttctaccgcattgtcaagctgcaaatttcccaaactttatgctctgtcacctcttgaatgctttgctttagaagtcaaaattctaaaacagaattctaaagaaatttctaaagttcagaaatttcttccatcagataccctaaatcatccctctctagttcagatatctagggcaggggcaaaatgccaccagtctctttggtaaactatagcaagagtcaacttcattctagttcccaacaagttcttcacctccatctgacaccacctcagcctggacttcattgtccacctcactatcagcattttggtcaaaaccattcaataagtctctaggaagtttcaaactttcgcatatctccttgtcgtctgaaccctccaagtatctaggaagttccaaactttcccacattttcctgtcttcttctgagccctccaaactgtttcaatctctgtctattaccagttccaaagttgtttccacattttttgagtatccttatagcagcaccttactctgtggtaccaatttactgtattagcctattcttacactgctataatgaactgctggagactgggtaatttataaaggaaaaggtttgacttatacttccacagggctggggaggcctcgagaaacttacaatcatggcagaagttgaagcaaacacgtccatcttcacatggtgcccaaaaggagaagtgttgagcaaaggggaaaaagccccttataaaaccatcagatctcatgcgaacacactcactatcatgagaatagcatgggggtaactgctcccatgatttatttacctcccaccaagtccctgccccaacacgtggggattacatttcaggttacaattcaagataagattcgggtggggacacaaagacagaccatatcaggttttgaacacaaggtttaagagaagtttaaagaaagtcctgtggaagagctaaatatgaattcccaacagaatctccccttggccaacctccttgtcatcagttcactggctaaactagtgctctgcatttccttgtttttaaattgtgatgaaatatacacaatacagaacttaacacgttaaccatttttaagtgtacaggtttgttacttttaagtgcattcacattgttgtgcagtcatcaccacctcatctccattacttttttcatcttaaaactgaaactctatgcccattacataactctccacgcttctcccagcccctggaaaccaccattctactttctgtgtctttatatttgactactctaggaacctcatgcaagtggaatcatacattatctgccttttgtgactgatttctttcacttagcattatattttgaagtgtaggataaatcatacactatgtgtcttttgtaactgatttctttcacttagcaatatatttcaaaggttcatccatgttgtagtgtgtgttagaattttcttcctttttaaggctgagtgatatttttaaggctgaatgatatgcccttgtatgaatagaacacatttgtttattcattcatctaatgatgaacacctggtttgcttccaccttttgtctattgtgaatgctgctactataaacatgggcttacaaatatcttgaggagcccctgctttcaattgttttgggtatatacccagaagtgggattgctaaatcatatgttgatactatttttaattttttgagggcatgctatactgttttccattttacattcccaacagcagtgcacacatgtccaatttctccaaatcctcacctacatgtgttatttcctgcttttttttgacagtagttattctaatgagtgtggagttgttagggtccagcctcaacgccacccacgggtacccaaagtttggtggcggcaaaggaatgagaagagacaagttaagagtgaaaggtggggagctgggggccagtgcaaaatgtggaggctgcaaaaggctcagagctctggtttccacactatttattgagtacaatcacttagatctgagaagcaggggttcaggggtgaaatggggaaaggcagacagtgcgttatacgtgtaatgtatagcagtggcggtttaagtgaatctcctttgtgctcaaatagtatatctttagttacttgttgggaccgggcttaactaggagcctgcatatctagccacattctaatgcttcataggagtgtctttctccttgaacacagtgtttatggataagagagcaagtcttgctcagagcatgggaacatagtggctataagaaggctttcttcttcagaggcctcttgtggctttccgcaacttattgtctcatatttttatggccagtttatgcaggcaccccataagcctttctcccaacatggagtggtattttattgtgactttaattcacatttctctaatgattggtgacactgagctttcttttttttcatgtgcttattgtccatttatatgccttctttggagaaatgtctatttcaagtctcttacccattttttaattaagttgattcttagctgttgagtcataggagttccttatatattccagatattaatcctttatcagatatatgatttgcaaacattctttcccatctgatgggttgccttttcactctgttgtcttttaatatataaacattttacattttggtgtagcccaatttatattttcttttgttgtctatgcatttggtgttgtatccaagaagtcactgccaaatccaatatcatgaagcttttctatgttgtcttctaagagttttatagttttagttcttagctttaggactttgattcattttgagttcatttttgcacatggtgaaaggtaatgttccagcaacatccttttgcatgtgggtatccagttttttccagtagcatttgttagaatgactgtcctttctcccattgaaaatcttagcacccttgccaaaaatcatttggccctatgtgcaaaggtttatttcaggactctctattttatttcagtggtcaataagtctttatgccaacatcatgctgtcttgattgctgtcactttataatattttgaaatcaggaagtgagacttccaactttgttctcctttttcaagattatttttgctgttcactcttaagattccatgtgaattttatggtcaagttttctatttctggaaaaaacgtcattgagattttgatagggattgcattgaaaccatagattgctttggttggtattgacatcttaacaatatcaagtcttccaatccatgaacatgggatgtctttccatttattggtatcttctttaatttcttttatcaatattttgtagttttcagcatacacatctttcacctccttggttaagtttattcccaagtattttattctttttaatgctattgtaaatggaattgttttaattaccttttcagactgttcattgttagtatataaaaacacaactgattttcgtgttgactttgtattttctggtttattagttctgtcaggttggtgtttttgtttgttctggtggtatctttagggtttctacatacctttagggtttgctacatataagatcatgtcacctgtgaactaccccattaagctttatattttaattatattttatttctacatgttccttttgatactttttcaaatctgctgggtcattcttcatagtttcttatttcctgctaatattttaagcctgcctcaggagatattaactctgttgtgttctctcataattccaaattatgtggctctatttcctatttctgtgtctggtgtgtgcccatttttgttcatgatgccttgcttccttgctattttctctgtgggataagtatgtgtttagtccaagatggggaggggggtatctccaaggaggatttgtaattccttatgcaattgctttagggtgctactagcctaaattctgaggttgaagggtttttggaccatccacgtattgtgaattagtgcagcagccctaaggttcaagactggcagtgactcccagggttgttgggggcagatttatgtttatttctatttcatatttatacctagggcatagccctttggggttccagtcttagggaaggaggatcttctatttcactcctcactttgggcaggtcctgaacacttaccttctccacagtgaggctgtgaaactcaagttcagctgcttggacaaatgctctcaaggcaatggcctcagtgcttagctagtccctgagttttcatctttacttagttcttggcctgagtactcctgttttgccagctcatgggtttattttctatatctaaggtcaccatttttcattatcagaaggataactagtcaaggtagctgcccaccatattgccagagatacaaatgtctccctgaacacttgaggtctcataccatcaaaattctcatctcaccttgtcaaccattcctttgatatcttccactgaccactgagaattggtcttcaagccccagtccttggcagtacaaagggtaattagggagtgttgacctacaattacctaatgccactatgataactccccagtaacggaactcagcttacatgcttacccaaattgcagccttaatttcactataaaattttctctggctgccttaccaagttcattgtttatatcattatcactaatttcttttctccaaatgtaaaatttttagtttaaatcatgaacaaagcgatgttgttttcctttgaaacaccccctttttctctaagtctatcctaattccaggtcttactacttcttatagaggtgaatccaacatgttttgttcacttacctgccttcactgtgtctactttcaaattaatctttctggaatagtttttattatatcccctccccccacaaaaaattaaaactattccttattttccctctgataattttagttcaacacattttgagcaaatgcctataaaatgccaagcaatctacaaaaatttgggatactgtcagttttctattgctgctgtaacaaattgccacaaatttagtggcttaaatgagaacaactaaaaactattgttttacagttctataggtcagaagtctggtggagtctcattggagtaaaatcactcttagttccttgcatctgtaggactaaggtcccattttccaaaccactttcctgtcttcctcttccactgtgaggggttcacgtgattcactcgggccttcctggataattctgccttcctcttccactgtgaggggttcacatggctcgcttgggccttcctggataatgcaggctcatcgccccatctcaaggtcctcaaccttaatcacacctgcaaagtatcttttgccactaagctaacatagaagccacaggttctggggattaggtctaggacagggattccccagcccccaggtcacgtaccagtacgagtccacggcctattaggaactgggctgcacagcagctgagaggtgggcgagtgagcattaccgcctgagctctgcctcgtatcagatgactggcagcattagattctcatgggagcacgaactctattgtgaactgcacatgccaagcatctgggttgcgtacttcttatgagaatctaatgcctgaagatctgaggttgaacagtttcatcctgaaacataccctaaacccctacccaatctatgggaaaattatcttccatgaaaccactccctggtgccaaaaaggtaaggggctgctggtctagggtatctttggggggctataattccacctaccacagataacataggtgaagaaggcctcaatctgtctctgaggcttcattaacgcagagagaaacagagtgcgaacaagtaaccactcacctctaagacatctattccattgtatcagagagggctgaggacacaaagaggaggaaactagaaagaatgtttataaagatcaggaaggccttacagtctaaatgaggggaaagcttgccagataggaatgggagttcttctaataggaagagatagcatataaagtgagagaggcctgtgaagtgtttggcaagcttgggtaatcacaactgattccatgtgactaatgggagtaagggggtgggatggtgacattacaagagattaagatgctggccgtggtggcacgcacctgtagtcccagctgtttggaaggctgaggcacgagaatcgcttgggcccgggaggtggaagttgcagtgagccaagatcatgccactgcactccagctagcactagagtgagactcgatctcaaaaaaaaaaaaaaaaagaaaaagatgtgaaacatctcatcttggactctttctttttagcattaatatgagaaacagaatcttatttcaggaaaattactcctggaacagtacagaggtcaacctgaaaggaaagcgactggagaaaaggagacaaatgtaaaaccttgctaacatttacaagaggaaaagaaatgaacacagtgagcgtggggagaggtagatatgaacagctctgcagttggaggaacaaaccttggaaataaggagaggtgacctgtgtttagctgcacccctagagggtggaatcggctgaggagcaagcccagcaacactgaagttcagagatggagcggctgggcggtgggcgagagaaactcttcggggacacatgtggttcatttcaggaggtagctaaactttctacaaagttagtacgtaattacacacttattttttaattcaacaaagtaatttgggagagcttcatggggagcagcactgaggtttaaagagctgaggatacaattatcttcatttaactttctatgctaaaatatttcttaaaaataaagttgtgcagctattactattcaaatatttccttaaattaccaaatatttgctagattgacatatgttgtttaacttttcctaatgagactaaactcctagagctaggatacgcagtatttcttccaagtttcctctcaatacctagcagatagattaaaaacacactttttgtgagctatcaggtagatacttttaattatcctacacaaagaaacaatcttgggatgatttggatggattatctatgtcttcatcattggcattcacattgcttgccattcttacttgccagtgttacagaattcagggtatactgaggtggcagctcggtgatggacagctgttcatcttctcaatgatcagccacccctggtcactgcacgctggaaaagtacctagtgcaagggaaggacctccattttttaattgcactttatgttaacttcaaaactggcattaattcagttattggaagacacttaactatcttttgaataatttgagtatataaacatacataatatcctttttcaactctaagtggtgtgaaatctaaacagatcaagtacttccaatgaaaatttcagaattgagatgttgtctaagtgtaaaatatacactggattttaaagacttggcatccctcaaacagtaaaaatatctcagtaatttctaaaaatattgattacttctggcagaagcaatatttggatgtattgtctacatattaaaactaattttaaaacatttattgtagctactaaaaatgtttaaattacacattgttcccattatatttctattagatgacaccgagccagatgaaaataggattaaatgagattttcatgtaagaaataatttgtccgatctaatcatttttttctaagaagtatttacttgaaatctttttatttttatatgttcatctaagtccctcttagtcaccaaatcaatgcttaacagctgtgcaagccagttggctttagacagctcctggagtttttaaggatcatttcttggcagctttagaaaaaaaagcactaattgaaaggttaatcaaatcagtcatatttgtatgttggttatataaacaccctgtctccaccaaagattaaacagacgcattatactctacccagaaggcccatttattctgtaatgattgtcacttgccttcaagcttctaagtagtagggaagtactttgaatactttgcaaatgaaaactctattctgatttatgaaatgcttccacactgccaggattctacagaatctaaaatattttatagcaacaccaattctacctgtggtacacaaggggaaaaggtcagttctacatctactcaaagataagtcagtatctaagtttatttaagcacaaaaatataagcttaaaaatagacatattttgaggcacaatgttggttaaaaaacagctctgaatgtctgcgacagcactggtcagcacgatctaaagatattagcagttactgccctgctcatctttaataaacaggcggtctcctaccattttatcacacctatgatccaacaagacgtgtactgcaacagggtctggaaagaagcaggatggatgcaagttccgtagcgtcactggttctcactggttgcgcctgtgcttagtgattgcaaaataatctgaatccacccctgcctgggatggagtttattacggtgacaaaaaaaatggctggcttctagaaattatttcttgaggtaaaaattgactggaaaatattttgtcttgaaattacttaaaatgtgatccggtttgatgcaaattataagttatgcaaaaaatgtggaataataaaggattactcaattctaagttcaaaagtacatttatttaaaatgtgggcaagatatcaatataaaagaaaacagagtataagaaataaaaataatcaaagtacaaaacatttcaaatctttaacatccataatttagagatagcaaggtctttatttacaccattttatttctagttgaagtcccgtaacagttttgtgaaaacatttaaaaacctggcaaatgaatcataaaacctaatgtgggctcttaaagtcatataatacaaaacataatttatgtttcctcagaataaaattgcacatcttaaaaagatgcagtatatttattatatctgtcttcctgcttcacagtctgatcccccaggaaagcagctggaaaacaagagcatgtgaaggaagcgcagcagctcctcgccagccagacagccagccccgcaccgcaggagtcgacatgcacggcagcctagacgccatcagttaaacttatatgtaggcttgttgaggaaaacgactttcaaacacaaggcaaaagaaaaacatgaaaccaagggttccaacattcatcatccagtttcagagacacccttgaaggaatgctacagcctctttcttacccattcaaaccagtcgctctgctgcatacccacatcacaggaggccctcagccccgacacacaggctcactcagcccggggacatcagcacctgtgccagctccgcaaggtatccaccatgcggccagaactgaggcccagcaatagctgaaatgtcctttaaattaacatgtacaacacacaacccccaagagctgacatccccaaagccccaccacaaatagctgactcctacttatacctgcaggagcaggtagtgacctctgcaattctaaaccgtccactttgggcaaaattcatcaagctatggatatgaaaaaaggcccccaaggtaatactcataagtctcctgtatgacttttaaagcaatttcttctgaaagtaaatgtagtgtagaacaggctttcacaaatacaaacatgaatgttaggaaaaagtctggaaaaaatgcaagagtacatgttgtataaaaaccaaatgcttatagcatatctgtaaaaatttaacaggcctcttatcattcctatcagtagctcctacaataattttctaatagatggcggtatggaatacagcaagctctggtatgaatggtaagagcgtttctgcaccaagcctcattccaactagacaggctatttatttatggctaaacatgacattggattctgggactgaggcaaattttacttctttttttttttttttttttttaaagacagagtttcgctcttgttgcccaggctgtagtgcaatggcgcgatattggctcactgcaacccctgcctcccaggttcaagtgattctcctgcctcaccaagtagctgtgattacaggtacccgccaccatggccagctaattttttctatttttagtagagccagggtttcaccatgttggccaggctggtctcgaactcctgatctcaggtgatccacctgtcttggcctcccgtgctgggattataggcatgagccaccacgtccggccaaattttacttcttaaaagtgcttttctctcagtgatatcaaggtcttctgtctactattataaccataagctctttagcgttaagaggaaaatgtttgataaatgtaattaactggatgaatgtcagtgtatttaaatgtaaatatacttaaatgtaattacctggatgaaacaggcacacacgaagaaaaaaaaactcggcaaggatgggtatcattctgacctctgcgccttactgaagcagtcctatcccaaacacaaaattcccctgcttaaggaaaggtccactgaggttgacactggtcagaggtggcagaggctcccaccctcacagagaggaggagctccagcctcattgcaggaggcccagggagaagtcctgagaacagccctgagagaaggtgctctgcaatgggaaacggaagtggaaacagaattttcccataaggacctgtaaggcatgttttgcttcactgataggctgttcctacattaaaataataattcagagatttttaataaggaattcaaataacagatgatgagctttattttttcctgaatgtctgaaatagaaaaaagcctaggtgtcaatattctaaagactgacctttgcattttcctgacatgttgatgaagtattcattctgccgcttccatttagtagtaatttatctcccatcccaaagttcctgagtacaaagactatatacgaactaaatttcatttggaaaactacaaactcaaaggtgagctgataaaaagaaacatatatttatttttgcaattattttctattttatctaattgtcaaattctttaatacctccataaactagacagtatagatcctttctaattaacatcacctattaaaactgaactctcagtaagttaagagaatatttttactagcaactcaaatgaatattctgaagagaaaagaattgttcactgcataaatcacaatagcaaagaaaggaaaaatggcttgcaaaacaggaaaggtactgccttattaacctgggaaatccatttcatatctaacccgtctactttttaattctcttttggaaaggatatgattcatagtccagcgtttgagtgagcactccagtcagaacgaactctgcattgtgaacatctgaacagggtggaaacagacactttagttagagatccactgctgtgcgtgcacacatactcacacaggtaagcggggaaacgtacctatgcctctggcaaaatattctcggcataaatgaaggtcattttcacaggatattaaaattatttccgacaaactctaaggaaaagaaaatgagtttctcagtgaccgaacgctgaatgtgatacagggcaatgacggactcgctggcggactccactctacccaccgagttctgcttgtgctccatgagcttccggaaagatggctgcttggataacacctttcctcctgcacactctacgattgccttcatagtggaaagacttgggcagattccaggtgtgatgtaaaaatattttgcctaaaattaaatgaaaatatatgtattatgttcttaaaatgctttaatttttagagtacataattctcatagattctgccctgagatttttgacaaaatttcaaattttatgacattatgaaggtactattctcctactagcactcaatctgaagtggaagaggaatccagctatgtaaatttggaatgtaagcattttcacatgttaagtatgcctgaagatgatttaaagtaaccagaacttaagtccctaaaacaaagtgttttgtgaataagcaagaatattacaaatatttttcacaatttctatacaattttaaatcagcattatatttcaccacacttatctgcccagcaacagcctctggcatagcatgctgcctggcttatatcccttttctttattttctccatattatttgaactcagagcaggaaatgatattgatgcttaagatttaattatctaacaagattgctcctgaggataccacaaaatactattctgtctgaaactgcaaataatttctaattcctgttgactccttaagaaggttaaagaaccgattatctttattgatttacttagttctttggtacaaaaaaaattcctagctgttctaacacttatctaacatttaaaaatcttttagtactgaattatatctatgcacacactgaatattttcccaagtatcttctccagctgaatatacatttactgacaatagtacgaagtaagcgatgtcctctaaagatttattaaaagcagaaaaatgaacatgcctcttaaccaattactcaaaaacctattctttgaataacttatttctcatagatgtatttattaaatttgtgtacttatttttaaacattatagtaaagaaaagttctctagagatgtgctgtggttcacaggaggaagacctccagtggcaatgtccaagaaggaagccaagaggtaaatgggatgcagggtgagcccagctcccctggaggcgcacttcccaccaaatcacctggtagttcccttgagcaggtccgtgtgttatgcttacttggactgatttacttttcccttaaagtgtaccttaaagagtggagaaacgtgtgcccgttttaaggattcttccaagctgaaagagaaaagtacttctgcctcagcatctcggagaatgtagttctgctcatctggaaaacagaacagcacatactctgaaaagtgtggacacgtgaagtgtggcaagtgtgacccacaaaattctcgcccatattcaggtacataatattacagctacatttacctgtacagccttcggatatttaaatgtcaccattatatttcatttacttccctctaaaaacagccagaccaaaaagacagacaggtattttttctcctagatcagtggtaattaaccatttggggtcataaactcttgaaaaaaacgggctgggtgtggtggttcatgcctgtaattccagcactttgggaagccggggaaggaaagctgcttgatgccaggagttcgagaacagcctgggcaacacagtgagacttcatctctacagaaaaattttaaaatcagcttggcatggtggcatgtgcctgtagtcccagctactcgggggactgaagtgggaggatcgcttgagtctgggaagttcgaggctgtggtgagccatcattgcaccacagcaccccagcctgggcaacaaagtgagatctggtctcaaaataatagtaatttttttttttttaacaacaaaaatgtaaaaaaagaaaaaaaaaattactgaaaaatatgaaccctcttcccatagctgctcctcccctctttaccccccgactattttaggaagttcaccaactttccaagcccgcagatctcaggttaaaatctccagtcctagaaagacaagcttcaaataatcccatccaagtgtatattatatatatatatgttatatatatacactaactcctcaaggacttgtaggacattggagtcatttggctcataatcaattatgtgaattaccaaactttaaagatttaccaaacacacattcaagtatataaaagtatacagcaatttataaaggatagttttatcaatttttaaagacttctgacaattattaataattgacagattttcagttttcatagcaacattttaagaaatgtgtcaaaaggtaaagatcacaaaatgtttcaatcttcctataaatatgcctcatattcagaaaaccatttctcctccgccgccatttcctaccaaccatacagcataataaggcagctcaaacccaataatatatacatcaaaagcagaaaacaaggaaaagtgatttgggattggcaaactggggttgacaagatgatacatattttaggatttgtgggctatgtattatttctcctgcatattcctcttctcttttttaagcaatatttaaaaaatgtaaaaaccattttcagcgtatggaccagtttgctgactgctgggcaggagcaaccacatcatgacagaaatgcagggatctgttcaccaacggccagaaatacaaaatcaatccctgagtcaaccagcagatagaaaggctgctttttaggtgaaaggagaaaaagaatgtctaaaatttggaaaaacaaaaaatgatgaattaaaaaaggaacaaaaaaagtactgttacacatgagatggtatatttgaagtgttactttcaaagctgatatgccttctgaagaacttgtgtgagatcaccaagaatagttaatgtttatgatagagaaaacaccaccgggcgcggtggctcacgcctataatcccagcactttgggaggccgaggtgggcggatctcttgaggtcaggagttcaagaccagcctggccaacatggtgaaaccctgtctctactaaaaaatacaaaaaaatttagccaggcgtcgtcgtggtgggcgcctgcagtcccagctactagggaggctgaggcaggagaatggcttgaacccaggaggcagaggttgtagtaagccaatggcaccactctactccagcctgagcaacagactgggtgagactctgtcttaaaaagaaaagaaagtaatattgaaaaatacagtaatacagctaagacgatcctgtcacagatgagacattgagattttggttttttcaaacagggttatgttaccttagtagtagcaatgtaaagactcaacctgaacattaaacttttcatggaagtacaaaagaaatgagtatcctagaaattgattataatattgatgtctcaaattttatgtaagttacacataaatataaaatcccaaaaacatgcacctaccaaaacaggtggagaaaagagtgttttcaacaaatgatgctggaacaactgcacatccatatgcaataaaaggaagctggacacagactttaccctcttttaaaaaaaactgacccaaaaatggaacacagacctaaatgtaaaatgcaaaactatgaaactcctagaagataacacaggagagaatctaagggaccttgagtttggcaatgactttttagatacaacaccaaagacacaatccatgaaagaaataagaagtaacctggacctcacctattagaatggccaaaacccagagcactaacaccagcatatgctgaggaggatgtggagcaacaggagctcccattcactgcaggtgggaatgcaaaatggcacaggcacttcagaagacagcctggcggtttcttacaaagctaaacatactcttaccatatgatcaagcaattgcaaccttgttgatttaccaaaaggagttgaaaacttacgtccacactaaaacctgtacatggatgttttagcagctttactgctaactgcgaaaatttagaatcagctaagatgtccttgtgtaggtgaggggctgaacagatacattctgacaatggaatattatttagtgctaaaaagaaatgctttatgaagccatgaaaagacatggaggaagctgggacgtatattgctaagcaaaggaagcaaatctgaaaatcctatatactgtatgattcccaatatgtaacattctggaaagggcaagactatagaaagaataaaagatcagtggttgccaggggtcagcaggcaggaaggaatgagtgggtggagcacagaggattttcagggcagtggaacaactccatatgacgctgtaaagcaaaatcatgtccttacacatttgttaaaacccaatgactgttcaaggccaagagtgagccctaatgtaactatggactttgggtgactggccaagagtgagccctaatgtaactatggactctgggtgactagccaagagtgagccctaatgtaactatggacttcaggtgactggccaacagggagccctaatgtaactatggacttcgggtgactggccaagagtaagccctaatgtaactatggactttgggtgactatgacccaaatgtcaatgtagcttcattaacagttaataaacatttcactgtggtgtgggatggtgactgtagtgggggtggcggtgtgtgtgcatgggtatgggctggggtatatgggaactcactgtactttctgtaattttgctgtgaacttaaaactgccctaaaaattgtctatttttaaaaaacaataattataaactggaaaaattctcttaggaaatcctaaaatatggaagataaaatatgaaatgttttctcagtattaaatgtttataacaaccactttctaaccctcagagagcaacacagcaaatacttattaacagtgccataaagaaataaaagctagtcaaccaaaacttcccattaaataggaactgtaaactttatatacagataaaacaaccacattttcacaaactgaaacttgaaaaattaagtaaattggtcattcactaaattggctgcttggcaaactaattttcaaagaattagcatgttcttggttggaaaagaaaaagaataagcaaagtcagaaagtaacaaaaaagatctctaaagctgggtgttgcccaaaagcagccgatggagccaaccagaggctggaacattacagacccgctttccccaccacccaagctggtgtatgccatgctcccacagcagaagctaaaaaagtacacttactatttctattaacgaatagactatctccttctaaactgtataacattatatgaaattggaagctaaaatgtttgtagtaattgtttctactatgttcttcttctgccttcattgttaagttttatgtttcattaatacctttttagagtcaaaaaattttcaaaatttcaattaaaaaaatttctaaataccacttagtacatgcgagccgcattatttcacagattctttgctaattttcctcccctctgaaatttatttatgaacccacaatcagtgtctgtggcacttcggtggccatttgtggacgtacgtggactggaaaagattcagtcacccacatgaacgttcctagccgggaggaacaaggccatgccttgccttcctgttccagctgaaatggtgaataagcatcctttttgtgatctatttagtgctattgctttcaaatttgtgtgctttatgttggtgattttgctgtttaaaatgtccacagccctaagtgcaagaaggcagtgatgtgccttatggagaaaatatgtgtctcagggaagcttcatgcaggcgtgagttacagtgctgtggatcatgagttcaatgtcagtgaattaacaatatacattgaataaggtacctttaaacagaaacacacataaaacaaggttatatatgattggctgatgaaaatgtagtgaacagaggcgctcaggaacctaaccccgtgtttacccagagactacagtacagcattcactaactcagtgtctgtgcaactttatagagcataactacctgtatgacaagaattgcctgaatatcatagttgaggatttagtctttccttcagattaatgatttattctttcctgagtcttactgccttagatatacagaatcataaaattttaactttacttctagctttgctataaacagcaatcttaagtatctttatttttctgggtcttctcatctgtaaaattagactacatgaactttaagatatatacacttctaatttatttacataaacatgaattatatttaaaatctgtggccaaaaatgtgacatgaatctaaaatattttaaatttaaaagatggatttaatgacgacttgtgtctgttaagtgataaataaggtgagtttagccacaagagtgtaacgggacctagtagcgccccctgcaggccttgcttgctccacagccacatgacttgctcttccctttggcagctgtatctttctgcttaaggggtcgggggcgagggaggcataggtgagaaagtgcgagaacacgtcaatatagggcaaacaactggcacagaaaaatgagcatgtggatgctctaaatcaggggctggtgatcaatatcattgctacatgatggagtagccagggagctcagttttagtgccagtgtggttggggcagaaagaccaaatgagaaaaacgactgagaattcagtgaagcttgtcatggggcatgtgtctgagcctttcaacccagacagggcccaggggaggatggaggacacagctggggaagctgagaggtgcctgacctagatgacgcactggggacaccaaccctgcagacacagggtgacaccactcctatgcaggacagtaagggcacatagctgccctggctatacaacctccatgaagaaaaaaaattgcttagaatttatacttattttatacctagcaaggttctaaaaacatttaggtgtgtatcaatctaagaaaaaactatcctttacataccatgtctaaatgtgcctgttagtaaaagaatttctctttgggggctctgaacaatggaagatgggcaagaggacatagatgtctttccctccttatataaactgatattcaaagtgtatttgagtaggacatttacatacacctgctctctttccaaataaagaaaaaaatacttccctgcactttgaaaaatctcattttacagccagatttccaaacaaaatatactaacaagaaaataaaaagagggatatagaggttgttttccccctaatattgtccaatttaccaaaacttttacacctagggtaaaatgcaaagacatcaatcaaaggaatcactggggatatgaaataaatttttaaatttaaatgaataactatcacatagtttaaaaattaaatatttgttgggatgaaaagagatgaattcaagaaaaaaaaaagtttatttggcattaaaagcaaagttactggcgctgctccttaccaatgaacttctgacacctgaagcattcttccagccactctggcgtcactatgtgcttcacgacagaaatcgccgtcaggaacttcacggtgcgagtcactttgctggcaatgaggtgtgtgcacttctgtgcagactccgcaacctctccaccaagaatgtagagcttctaaaggtcacaaacacaggtcggaaatgaaaaagttcagcatccacagagccacactgacacagagtaacacagaggaatatctacctaaagacaaggtttatgactgtaattctcagccacagaaaacagtgtgacaggtaaaacaaaacctgtaactacaagagaaaaataaaaaagagaatttatcatttacatttctgtagttcaattccacacaaatcaagattaaaacatgaattctccatcaaacatcaataacatatctccatgaataaattaaatgacatgagaatgatgcagctcacttcacaatgaagagtaaacagccaagacttcctaggccaaaactggtgttaatgaagaacatttacctgctatcttcattttttgaaatgatagcataaaaactggctaagacttgagcatataaaaaagcgagctcctaataactatcctcacattttaaaggtggagaaattaatttgttctaaatgtataatactagcatttataattgtttcttttccttaaaaaggaaaccaggagtaaaatgtacgaatccaccataatacaggtcaacttatactcttaaccatcctctccctcaccaaaacaaaacaaaatcccatcatcctttgggatgttatttcaaaaagtatatttaaaacctgtgcccatttatcatctaaacaaatacacaaactcctttttggcctcactctacccaagaaaactaatcttggatagactgtgtttcaatcagagatcttgaaaagacagttttccttcatgctggatgtctttatgaatacgacacagaaggagacttgcaaatgttcatgtgactattaacatggttcctggcctatactaataagaaagcaagtatctaagtatgaaataatagcacagaacagggcaggaagccactaaatatttagttattactataaatactactaaaaatacttcataaatatgcaccataaagactgttataactatctaaactatgtaagttaataaaactgctgatctgaagtaaatatatacaaaaaaggacactgctaaaaatccttgtacgaagtagatgaaatttcaccttaatatactgttgaacctggacaggctcgaatccagtgaaaagcacaaaaggggtcaattctggagttagctttttagtgggaggtggtacgtcttcaattctgtggaagaaatacacataaaatagtagtgatttcatatttacttacaatgaaaattttctttagaaaacaagggatttcattagtttaacaagctttaactgcatgtggtttttattcttaaaggaaaaatacaatgagctatctgtccttcctttctttccaccatttccataaagtcaccttccaaaaaagactacctttgaagcctccaagggaggcatccaattcacttttggttaagatcaatactttcttcttcatcaatcccctcctgattaatttttttaattggctttcagaagaaagcaaatatcaaagttgcttctaaacatcactgattttgctagctctatcacttcatttttttctatcaagtttttaagataaccttgtgtgactcaggccattccttgtttgcacgttcaccatcaatacaagtcagccaagacgagtgtcgctagagcttccagtgtctttcacattctagccctcttcaaccacaaattataaaaacgtggctctgctcaagcacacgttttaaattaaacctttttgttttttacatgaattttttaggtctttttttcaggttattattttctgagacagtccaataaaaatttattttaaaatgtatttgtggtaatttgatgacagcctcaaaaaaatcacataattaggattttattacaaaagtcaacagttcagtttgtgttctggaagtggggaatggaaggagggaaagaggaggagcagggagagaaaagatgaggaacctggtaactgcaaaaaacaattcaagcagttatatttcaccatgtacagtctggaaagaagagttttctagaatcaaggaagaaaataaaagctctgttagtttgctcctgcatttgctatgcctttctaattaaatgattggaaggacttcattattgactcctgctggccgacatgacactaaaatgatatgcatctcaatctgcatactccaagccaaaacccaacatgccatatgcattgcacatgtccttccaaaggctttgggtctggatcctccttcccaccgtggccaacattgctttgtcctcatcaagaactggcagatccaaggagcatacccaagatgacgccacagcctacatgctctctcggcacctacatgctctctcggcacctacatgctctctcggcagcctacatgctctctcggcagcctacacgctctcttggcatgtacagcaggttcttcagccgtgcccaggaggcctggggctccgtggtctatctctgagctgggttctagacctcccaccccacttccaccactgcaacttctgttttacatgttggaaaggggcttcttataatatgccacttaaagaaaaagactgaatttttttaaaataaaaaatatactggcctatgtcattaaaatgaaatatatcccaataaagttgtaaagcaaaaagcaaactctttcaaatcttatttactgcaaaacattttagaaactttcctcaattgccaccgattttccaaagcagacctgtgaaagccagcaatgaaaaatttaaggttattactcatacctggctcttttggaagaaggctggacattagctacttcattctgtttcagtttgggaggtagtcttatactctgcaattaaaatattgtcgactttaattcaatcaatctactaagtaatacagtagcttccagaagatttatgtgtcaaataatcaaactacttaaacatatacaagaatcatgttcttcttcaccacatcagaactagtcttcacctcaaaagatcactaggacaatgcaagtggggagaagcagctaatattccggagagaacctctgtatcgtttttttgttcttttctttccctctttattcacaaaatcctttcagtactttaaattatctttgttgctttttttcctccatgttatatatatgcagccctcaaccttgaacttctcaaaatggtttttatttcaaatattttgtcctgtgtcccaatttagaatgtggaaaacatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaaaaaaaaaaagaatgtggaaaacatgattgaaattacacctccaccctaaaagactattcctaaaagagaaatttcacctatgagatttcacaaaagatgttacatgacaatcagatcaacactgctaccaacagccagacaaggtaccaaaacctacactctgcctcagcaacatggtcacatccactaggaccagctccagtccctgaccctggagcagaagccatgccaagcacaaagagagcaggaaggagatgggattcccttgtggggtccctaccacagtcagcatctccattctaccctattccttgttgactcctccttcatagtttcaactcagaggttctttgacttgtgtgggccaaccatgtctttcccaggtgttttattacttgaaggaattgctctcaatcttattaatttacttcaactacaacttattttttctaaatattgctgccatatctagacaaccaaaataaatatatctacagaaagcattcaaaatctattagccctgtcatacatagagaatcaagctttataataatttgcaggaaagtttattactttcctattatagcctttataagaaagcaatttctcaactctatttccaaagatcgcatttaagtctccaaattgtcattcattggtaccaagaatagaaacaaatggtgggataggcaaaaaggataaactgggcctctttgtctctaagatttttagcttttaattactgatacaaagccacaagagaagctgacatttggggcccctgacaactttagaatataggccatgtagtttgggaggaaaactctgatgaccactttcccagtgtgagcttaaaagccaccataaaattcctttcagctaaaagaactgtgagaatatttgcttttgctgatgtgtcaaaactggtcatgtctttaaaattaaaatcataactactagtttaagctaggaaaacaatacatctatgatcacattatcactagcaagaagaaaacaagactgtggcttggaggggcttcctcagagacgtgggatgattatcagcagcttccagatgagatctggaaaacgagtaagtcagtagatgaataaccagaaacacaagcttgggtgttagctgctaatcctcatgaaactattctcctcagctagttgttcaagtggcacaatccctaaattacctctgtatacaatagaaatgtggtgaaaacttggtgggcacatgacatggaaatctgtttttcaaaacaaaggttagtatgtaacaacaagaacataaaccaaagcctttaaattacactactactggccaacagtaaaaaaaactgctgttctcaaagtgctgatgttcagtcgaacagtgagaagtcacagcagacaaagtctaaactgaaaaattattgaagtggtcctgtctgtaacttagtaaacgtgaatgtggggaaaagagaaaaaacaactgatcttccactcatcatgcttgacagatgagaatgcagaaagcacctctttgtcttgtaactaacaaccaatggccctcacacttcaagaatggcctatcctgaaaagcagagacctccagccctgtgatgtgactcccaactcaggacactatgaaaacattcccctcatcaagagacccgggactccttaagttctgatctgtagccccaagtaggttacacacccattgcttccagtggttcttaaagttcttgcctttctaaccctatgaaaaatcagtcctaggatttactggagtagataattcgttatcatgttgacaagttactaaaataatttttaatttatgaagacaaatacatccctactgcatcttaataatacagtaatagccaaggtaaggttattaatttgacataccatcaacaactctgcagacacttttaagggaactctccaagcatctaaagagagaaacacattattttttatgatagatacgttgtttaaataaaaaggcctttttataaaagtcttccctgataatcctcaccagacaggtggtttagctgacaacacttaataaggataaatgtaagtactataatgaagttttaaagaaagctttccaggcaaggtgagggcatgctgctgctttcgtttcacatgctgtctggatgaagtagcactaagaccatcggcagcaaacaacaaagcaaacgttgtgtcgaaacccatggcattcaccctcccaccgtgggttgtctgggtacacatttctaggcctgtgtccaagtctgggtttcacatagtctggcttctagcaggcacaaaccttcttgccttatcacaggagccatgatggcatccaagatgtaacagcaagtcagtcaaagctcaatagtgacaaagaggacagacgtcaattctaggaaagcagggaatgttctgtagggtagggagcaatttggacaaaagattaactggcctgagaggcaagactatcaaaaagctttcaagcgctccttccatctctaagagttcatcaaaagcaaacaaaaatactaaaccatggcacatgcctgtagtcccagctacttgggagggtgaggtagggaaatcacccgagcccaggagatcgagctgcagtgagtcatgatcacaccactgcattccaacctgggtgacaaagcgagaccctgtctcaaaacaaaaacaaaaacaaaaacaaaaaccaaccaacaaaaatcctgggcagagtggggagaaagaagaaagagtatagaaaagaaattggaaatgagtcaaaaactaattagaaagctcaagccaggcctggtaattagtatgaataaaaagatggtagaagtaatgctaatgattttatttaagtaagatttgcagcatgtagaatttcacttacctaaaagatttaaaactaaatgctgggtaggggcaaatggatcctgcagactgaatgccgtgtagcgactatactgaatctgcctcagtgcctcaaagtttcccagaagaatgtcgccaagccactgggcgttgacacagggtatcctccactctttggctttttcatactttaaaccagttggtctttttattttttgaggagaaaacatatttattaaatgttagagatgtcaactgtccaaatgtacatttatttccaacaaaaggcaataaaaaatttctcataatagaagtgggaggcatatcctagcaaagttgagggtgaccctgaatggtaatgaaatatacacctcaaggctcacacagaattacaaaaccactaaggagtcttacttctaccctattcctgttttgttcattcaaatttcattagttcatctaatttcattaattcaaatgttttctaggtatttctactaacattactatatcattgtcatactttaacagactttgatttccacaaatttctaccacaaaactatgacatactaaaaaaggcacaattattgaaatagccactatattgtgtgtaaatttatgattaaaaacagtttcgaaaatttgcttactctttacagatgaggactgtgttgctgcggcatagataacccgtatatttggcacctgccaaataagccattaattttaggtcatctctgtcactatcaacaaatccagtcacagaaataatctaagaaaaaaagagaaaataaggtaaacacaaaataagcaaaaaaccaaaaccaagtactatttcttctacttcttagttgatacatattttttcactatttctttggcattatggaacacatttggtaatatcattcctaaaactttcaagaccagaactgtattaatggtcaaaaggttacacacatagccctcacggggaggaagaaaaagaatgaacatgagatgccttgtttatgttactgcaacactgctcagacaatcccaacagttatgttataaagcacgtaaccacgagccagctcctccttctcctcactgatcccaacgctgagatcatttgagtgggaagacccacaactattgattagttaacccaacaggggccgcctttggtgcaagacatctgatttatttttggattttaaatagtgtcaaagactggagaatccattaaatatctactatgtgcagaaaattgtgactgttacacagaactaaaagaaaacacactatttcttatgagcaggcacttatgaactgggcaaaagtacatagagaagctctgactcagaagccaacgcaggagcctcaggtaagcactagcaagtgattattcgccaaagtcgaaggatgatttaacaaatggaacgcgaggactctgtcttacatgctgtgaacatggctttcctcctggtgggaaggccactgggaagtgaagggctcggtgcggcggtaccattttcttcttctttaagactgtgtttaaccagtgtgcagtaacacatctctttctttctcttattgcctgtcaaacataaaattataggtttgttgtttttgtttttctgctgcaggattaaagaaaattctaaggttgtataactacaatgcccttttcattggaagccccataaaagaatttcatgacatctagcacttgattaaagtaacgaattaaaaccgtgtagctggttacttgaaatacaacctaaaaatgttactatccatctgcaaacaagagtctacaaaagcaacaaattctacaacaaccttaaaaataacttcagtgatgactgaaacaacatgtgtgaccaccaaagttaaaagtgccccataaggacagagggccccacataagaaaaaatacaaaaaaccatccacctaagatgaaccacaggaaaacaaaaaaaagtctcagaagtatttccacatttttacaggaaaagcagatcctgtgaatggctatcctctttaagaggggtgtcttggaagtcatttgtcacatatatatataatctgtctacaataagcattattttttgaaaagaaatgaaacttcagagagcacaggaaggtaatattgaggagaaagcctgcaccccggtagttttagaaaagctctgtaagggacctggtctttacacgcttgtgtgcaagtcacacaccagtacagaatcctgcgtcccttcaccgtgcacagagagcagctggaatggtgactgcagggagtgtccgccctttctttcttttatttttttttgagatggagtctcgctgtgtcactcaggctggagtgcagtggtggaatcttggctcactgcaacctctacctcctgggttcaagcaattctcctgcctcagcctcctgagtagctgggattagagctgcgcaccaccacacctggctaatttttgtatttttagtagagacaggatttcaccaggttggtcaggctggtctcaaacgcctgacctcgtgacccgtccacctcggcctcctgtccgccctttcttaacaccacctgggaacatccctttctttctccattgctcaaagacaatggtgcccacaaaagatatcaatcccaccaaagattcgatcacaggaagaaggaattttcctatctttagaggtagaaaaaagttctttccaaaaataataatcactagcatttaagattgcatattaaaaatgccagaccttgctcctggtcgcagctaaggctattttccttacctgtgcatacgcgctgctgacttgactctcacagagaaggtgcgtgcatcgactcgtgaaggtggggtcaacagtgccgccatgtgcctggattatctacacacaaagacccgaccaatgcagtcatcaatcactcagaatagaggagaattccaatttcaaataaggcagctattaaaagactctatcatatatttatatcatgtatttcctcaaagtatcaaggacatgtaacagttctatttacggacttttctacccagcaccatacaatgaaaatgaactccaatactctaaatttaatctgaattcccaggatacaagagaagaacaatggaatgcactccagggcttctcaagctcaatgtaactgccactctggaccagggagttctgggaagtgggggctgtcctgtacagaggaggatgtttggcagtgtccccaacttctacccaccctatgccagcagcagccccctagccgcgactactaaagatcttcagatactgccaaaggtctatggtgggcagatccacctcccttaaaaagggaaataaaaagcaaatcagaatgaaattagtaaatcccaacagtttcttctcaaaacacatctggttttctgggggaaggaattgctctgtgtccgggctgtgacagctgcacgaccctggacattcttcagaactcaaaatattgtacatggaaaaaggagaatctgacggcctattaggtgaaatataaactttaaaaagacctgccccctaagaaaaccgattctttcacttactacttttaagatgtgaatgtttatttttcctatggctaagcataaatatagtttaatgaggcacaggacaaaaccacaggttcctcacccatccctgcttttcactcccctgaagcacatttagcactttaagctgtttccactgacaattattaatatattccaactaacactttatattagttccttttctctagttttacataaccatctacctcctactgtggacaccgttccccccaataacacacacattcttcaagccttcctgatttggttatatccagactcttgtttagatcattcatcagtgacttaacacaatgtagcccagccacatggcttaatatggcagcctaagattagagttcctttctggtataaactttggttttccctggtgctaatcacttcctcatcccagccccccagaattttcccttttcttagttttctatataccttttactatttcattcccaaactctatgaaaaatgtacatatggtggttctataatatgtctgcaaattactgtatactcctccctctaagagttggagctttactcccctagccttaaatatggtctagacttagtcacttaatatggtggaattgacagtgggagtctcccataactcagtcacaaaagacaccataacgctgcgggttttccctctatcttgggtcacaccccctggggaagggagccagctgtcatgctgtgaagacacacaaccagccctctggagagcctctgtggtgaggagctgaggcctccagcccacagccatgtgacggaaccatcctggaaggggctcctgcagcctccgctggcatcctgactgcaacctcaggagatagctgagccacaaccgccctgccaagctgttgcaggatttctgacccacgaccaaactgagaggtaatgtttattgttttaagccactgggttttgagataatctgttacacagcaagagaaaatgaatgtagtatcacctatacttaagcaacacaggtgtgaactgtgtgggtccactgatagctggattttcttccacctctgccacccctgagggagtaagaccagcccctcctgtccctcctcctcctaggcccactcatcgtgaaaacgacgaggatgaagacctttatgatgatatacttccccttaatgaatagtacatatattttctcttccttatgattttcttaataacattttcttttctttagcttactttattgtaagaatatggtaatacatatacaaaatatgcgttaattgcctgtttatcagtaaggcttctggttaacaccaggctattagtaatttgggttttcgggaatcaaaagtgatgtacagatctctgattgcatgggggtgagcacccctaggccccacactgttcaggggtcagcggtacatgtctctcctcaatctaccagtgttttcgtttgcttgctcctcctggaagtctctcttccggtcccaggtctagttctctcgacacctactttctcatctattggcgtttccctttacctccatcctaggaactctctttcaatctctgagtcaaatgcctcatttcctggctaccatgtttcactctctgctggcatagtggcttcctaagaaagaatataagggaggtacattttttaccattagtctacaaatatcctccttccatagtcttatgactgataggctctataggttattttaggttggaaattattttccctcaaaaatggaagaagctgctccattgctggcccccgcgcactgcactggaggctcccgaaatcacccagactcctgatctgtccacgtttcccctccagtgagcttgtctttgagagaaaacagttttctctaccagcattgtgaatgttcccagttgccttatcatggctctccttacatttcttttcaacctgagggcacatggccttcagttgcaaagctattttctttcataatgttcttgccttcattttctctgttcccaagatcctatttaatgttagacctcttggataaatcttttaacttgaaaacaagacaaaaaccccaaacttttctccactaacttttgtatctttgagttttgttgtacttctcaagacagtttctcagtgctgccttcgaacacttctgacttttaaaaaatctctgctgctgtccttctcagaactgctcccttccttcctcaccctggcacatgccatccgcctctttcctcagccagccacacagtcatctccctggtcaccctcagattcaaccctttactatttaaaatgcacagctgatcacttcacctgcatctaaacttcaccacatggcacaccaacaaggtcttggaagacacaccagccctggctcctgccccaacccctgcctcgtggatcccactgaggcaccctcctttgcaccctcctgtcagtttcaccaatcacatgcctttggctgtgctgcactatttggaaaatcctcccccctaattctcactcctactcatcctataagcagttcaggaatcacctctcccagcagacttttcttaacacatcaccccacaacacgatgggtgaaggtcctttctcaggctctcacaacagcctgcatttgccaccccacctctgcttagccgtgtggctgcctctcgcactgctcttccgttttctccgtctctgtgatttcgcacatattccctaagtcttgcagcatgcttggcacatagcagggatttaagcactagggatgtttatagtgaagcacattcaagatatattagaggcatatttaaactcggtttttataaaaaaaattttttgactcagttttgttttggggaatgcaagaaaaagtatttcttttctttaaaggccaccatgcatgataatacataattaaattaactccagtttcacaattgggctggaagaatttgaggttctagagattccaggattttctaacagttacctttggagaaagagaaatgactgagatgcatacaaattaatagtccctctcccaggacaccaaaaccctgaacttatttccattgccccaattatacacatataattagtgccccctggaatttccaagctgaaaaaaataaaaagtccaccatcttcatctaacagctgagaaaactgatgcccagaaaagtgctgtgcctcaggtcacacagaatgttaatcaaaatgcccgtcacacattcagaacacgtgcaggtgcagctcagtgaatgcagctaagtgaacacagttacatctacataagaaagaagcatcttcagacacagtcatccttcctccaggcacaatctcacccttttccaggtggccagcagttgcttatcagacatctgctctggataatccgcaattgcaaacacacatcccaataagaagccttcttctggaactagagtaaaattacataagaaaaagaaaattaaaaccctatgaatatgcttgcacaaaagttaaaaagtggcgcctcacaatgtcaatctgttatgtttatcagtcttgaccatgacgtatctgccagtaatcagagtgcatagggaatattgctacgaagatactatttaactgtctacatcaaatgatcattaaaaactaaaaccaaggtaactcatgcctggccattaaataccctgaatgagtccctgtggcagcctagatgttctacgggacaccaatattcacttcaggatatgatgtcccaaagtacaaaagaaagcataattatcccatggtaactatattctttgttaggtatgagactcacactctccattttgtagtaattgttttgatatgaatcctcaccccacactcaaacactctcaaagcatttatgtgggtacaagacttttaggagagaggaaaaataatctccattactaactctccactgctggatcatgtccaaaaagctgatgctgctgaggcgatggtggtggctgctgttgctgctgctgctgcgggggctgctgaggtggaacctgatgctgcagcgcctgtgacgtctgactcaagtgtggcgctgtctgactttgcatctgctgctgctgctgctgctggtgcatgcgctggagctgctgctgctgaatctgctgttgctgctgctgctggagcaggctgtgctgctgctggagctgggcaagctgctgctgctggagctggtgctgctgcagctgatggaactgctgctgcagggcatgctgctgctgaaagggctggagctgctgctgagggcgatgcagctgctgtggaggatgcaactgttgctgtggaaactgtagctgttgctgtgaaaactgatgcggatgggcttgctgctgctgctgctgttgctgtgaaaatggatgcggcggctgctgggggtaaggttgctgagagatctgctgctgctgctgctgctggagctgcattatctgctggggctgaaggtgtaaaaccgggtgctgctgctgctgctgctgggcctgctgctgctgctgtagcatgtgtgtctctggagtcactttcacttggctaaacagcactgcattggcatttgtatgtccctgctggctgtgattcacctgctgttctaaatttttcgtaggtgctgaaagagtctgtaagatctacaaaacaaaagttaggtgaaacattatcaacagttcctgaaacagatgaatgataatttcttagtcaagagaatggcatatcctatttattaacaatattcaactaagtagacacagcaaatgattggaaactgcaaaaacaatactgcattttcttttgtatttattttgtaacgccaatatcgtaaagtaaattcatatattgagaccaccaaaatttgaaactacatcagtaaaatggagtaaactaacgaattaaagtgacaaagactcagacggctgatgtgtttgccagagcagggcatgggagtcctgtgcacacctggtagctaagccttggtgctccctgcaccgtgctgcggcaccactccactgcccatcgcctgcatcagctccgcagaccctctcctggcccaggaatgcactgaggaatgacaggtggtgaaggcatctggtaatcgggctcagcctcacctcaaaccttctcgccacagctgccacttcccatttcctcttgtcttacagcccagagtctagtaaacaaaggttctcagtggatcaccttccagatgaaagcagcatgacccaagctgtgagtccaagagcctttcgctccactgtcaacttgctatgtgcactggcatgctatggaaaaggaggccagctaagacaccaccggggctgtttaaatggtgatgttcctcccaactaaggactcatcattagagctgggaaatgatgcttcctcaaaaatgactgagtcttcatgggggacacaaaaatatttcaagctagaaaaaaagaattcaaaccagactatttgtcttctagctctttctgcttcacaatgacagggaataagctgagagttctgtgtacgctgaggagtaggagaaggacggtgaccagcagatgcccaccaagcagagtaagttatttttttaatatcctatagggcactgaatacaacaagagatacacattatacaatgaattttgttcaacatgctcaagcaacaaaaatttgaaaccaacttcttatggtcatggaaatcagtaaaaatagattttacttaactcaatccatacaacttttaaccctattaaaagcatttaaaatttaaataaaattctaggaatttaacacatatcagaactataccaaaatctcaaacatattctaacatgtatctttcacttaaacagattccaaattgcaaagattatatgacctgcaagggtaacagattttggatttagtaataaataagggagtttagaattgaaataagtcaaaatcaagagcttgggcacacccatctctaaaatcaccttatgtatgagacatctctataaaaggattcaagacttcagaaacacctgagtggaactctaagcagaaaaatgtcttttaaacaaaataataagacaactgtttcatctccatatttaaaagtatttttaaaaatccagaaaagaagatgggacaattcaccccacaacatgccaccccatggagcccagcagcatttggtgctgtgcaaacaccccctaagaagcatgcacgtgtggggcacctgcctgcctggtgggcaccagccatgagccctacacggcaaactgctggaaacagcggctgcctcttgagaaggtaaacagcagcgaggggtgggaggggggctgagagtttaactgttcactctgtcctttggtatcatttgaatttttgaattttgtacacatattactttttcaccctcatatgtaaacagcccatggaactctgagggatggtaaagaaataaatgcccgtctgcaggtggacagggctgaactagtcattaccaaatgctgctccccgcctctctgtacctgccaagcccaggtggaagggagctcaggaacaggcacaggacctagacaaacacagcagcagacatcaggacagcacagaggccagaggctcctatttttcagattggccaagaggactcagcagggtctgctgcctgcagaaagtgctccatctgatctcagagggctgagggaggcctaggtaggacaggaggcaacttacagctgtttctactacgggcttgagttaagatgggtcctcatccactgctgacccagcccatccactgctgacaggaggcaacttaacagctgtttctactacgggcttgagttaagatgggtcttcatccactgctgacccaccccattaagggagaagaacagatggagattcaggacaagagtcccggctaggaatgaagatggccgttggcctggaaccttctccacttgaggaagcgagaggtgcaggcctggatggagaggagaaatctgcaaggccagccatcgagatgcctcccaaaacccctaccacattcatccgatcactttttcaaccatctgatctgcctctggctggaaacatgttagtcctggagaacgtaagaaaaagaatcttaattgctcaattacgtaattgtgctatactacaaacaattctgaatgaatgtcaagtttaaatttttccatcacaactgtcataatcctcatttacattaatactgagttactgaatgccatatatagaaagcagtatgatacacatcacatggcttctaaccactataaatttgcaatttaaacaggattttgatggtaagttacactccccccaacaatctaatgttcaactaaatctgtctcatatttctaaagtttcagtcattttcttcacatctagaagtaaaacgtccttatgttctcttgcattgctgaaagtctctcagaaaatctccgcaattcttctcactagtgatcaaatccattcactcactagaaatggatggagccttctcagttttccaccgctagagcacacagctgagtatatcaaatttgtctcctaaggacaatttccagtgcagagatgtgcccaaactccctactgcagtcaattctttccatttcaaagtaaattattttgtctctatatccaaatacaaacttaaggaactttatatttaaaccaacatccattgtatttgaaaaacataataaggccaggcacggtggctcacacctataatcccagcactttgggaggccgaggtaggcagatcacctgaagtcaggagttcgagaccagcctggccaacatggcaaaaacccgtctctaataaaaatgaacaaacattagccgggcgtggtaatgggcacctgtaatcccagctactcaggaggctgaggcaagagaatcgcctaaaccagggaggtgcagtttgcagtgagcagaaatcccaccactgcactccagcctgggcaacagagtgagactctgtctcaaaaaacaaccaaaacatatatattagaaataagtagtaactaaccagcagtaactgaccaacactttttgacaccacagataaatgaaaagcaaagaaaatttcctatttcaaatggatgacttctgtccataatttctcacctaaagaaagtgagaaagtagccatttctcgaagtgccagaggcttaatccatgatttctcacaccaaccctatgagagagatctttacggcccatatctcgcatatcccactgctgacaggacaggtccactgcgtggccgcagtcttcctgccaggactgggtcaccttctcaattcctccacctcagcagtatcatcactcttctcatgactgaggtcaaaaatgctagaatcctctttgcctctagcctgtcattctttatggcctttactttctacctgtcatgacatcctctggctctcaggacgactgtgtgatcgtcactttgctgctctgtggctgaggctgtgccctgtggctttatcccgcccacctgcctggacgcggatgtgcagggaccagggccggcaccctcagcattgggcggtgctggagctggctccttctgtgcatctaccttttccctaaactcggctgaccccagcgctctcatgggcacccacctggacaatccctggccttgcagctcttggacctcctcatcttggtggccttctccccatttcctcagccacacattcccaaccacccccaagacccatggtcagtggcaggcctgttttcctccgggacccaacaaggtgacatggagcggtgggcactgaagcaggcccaagagctcctaacgggcagctgctgttcagttacaaggcactgtcaccacccaggacttgaggaaggccagctcggcattttatcaggcatccacctctcaagccagaaacccaaagtcttccctatctatgaatcacctatttgaaaatcttctattctcctcaaacccgatgaccttctctctctgctcaccttctcccccaccatcttaactgtctgctgtctaacatctaaagggcatgtttgcctctatcttactctggatgccagccaaccgctgtcatcatcccaagaaccgtgtactactaatactcgctgcttaggtggaggggaggggagacaaagattttgtctgtcccacagcatttctaaacactacgtaaaccactgctattatcatacccaataaaatgatcattgtcaacatcaccttatacctacgccatactgaatttccccacttcatcaacatcaagcctttccactgaaagtggatgtggagaatactggatccggcttcaggttgttcctatatgctacagagccatttttctgggactttgagctgtcattatgaaatgaaagtgtccagaacaaggtgaagcggcagacggggtgtcaccatcagatggaacagcccagctggctctcaatggtgcggctcctcagagcctggccccagaccctcctcttgctctgccccacctactacacattctcacatccgcctccacagcttcagtcagccttgttttctctggttccaccacgtagcagacagcccctgcatggatcagatacctccaacccaacacatctgaaaagaaacttaggttcttcaaacctgcagctttccagtgttccttatctctgaaacagcatcatcttccttcactcgctcaagccagaaagctggatcctcccattcatttttttctgtctcaaactccaactctatgtcctcttaaggggcctctctgcttcactcttgcccctcaaagatccactgtttacacagagtgcatctcaccccaactcaaaagcccagtggcttccttccaagaaagaccatactcctcactatggccctatatggcaaggccccttttaaatccttcctagaactcattcaccttatgaagttcaaatttcattaactttcttttcttagaactcagcaaattcatgccatttgggtcttccttttgcctgggaactctgtgccctcagttcttcacatggcctctccttgtcattcaaccctgatctaagtcacctcctgcccgaggtccttcttgaccatctcgtctaaaatagcctccttcccttcacctgctattacgggaccctgattattttctttgaaacacctttcaccatcaacagtccttttgttcatatttctccacttactgtatgtcttctctacctaaattagttttcttagtcacaattttatctccagtgcccagaaaaatgcagagtggccaatataccacctcaactaccttctttctgtcttaaatagaaatatatgtacttaaaacttttaaggccatgcgtggtggctcacacctgtaatcccagcattctgggaggccgaggtgggtggatcactagagatcaagagttcaaaaccaggctggccaacatggtgaaactctgtctctactaaaaatacaaaaaaaaaaaaaaaaattagccaggcatggtggcacatgcctgtgattccagctactcgggaggctgaggcaggagaatcatttgaacccgggaggtggaggttgcagtgcgcagagatcatgcaactgcactccagcctgggcgacagagtgagactccatctcaaaaaaaaaaaaaaaaacaaaaacaaaacaaaaaacaaccagcaacaaaacttaagatccactctgtatcaataagctccatgctatataaactgtaacctgaaatcaagccttcctcaacaaatgcatgaatttgtgttatttatttactaccatgaagttcattataagcaaatcaggtacagctggtaaacttcattattctctttgctgccattgctaattttaaactaagtaagagtggaaacccttcaacggatagtactccatcactgacatcctggttctactcagctgctttaaatcttcaacttaaaatacgctgttaccctttttcaatgaccctgaaatatacatatatacacatacacacacacacacacacacacacacacacacaagtaaacaggttctcacacaaatactgcttgtaagttatttggtctgaaaaagcaaaaccaataaactacattgaaatagactgtgaaatccaattctaagatccaatactgacatttttttcggaaagagtgacttacatgtgctacatttgatggccggttcatctgctgaatgtcagcattattagtaatattcctcagtgtccgtacagctggactccaggtagctatcatttctgatctttcagaactttggaggttttgtccagcagccattaaattaccccggacctcagggggcaaaatgttacctgggacgggtgggacattggcacacaagttaatcaacccaggctcctttccctgaggcagcctgcgttttgctgcagctaactgtgggacttcggccggggtccagtttaaatttctctcctgtttttccggtgatgaatctgaagaatcatcaaacattaattcccctttagatttttcagtgttggatttaggtgaaaactgctggtcacctgaaggagacccttcttgagagctggcagggcttgacttctcatctgtactaccctcattctgagaatcttgttcctcattttctacttcctcctcctcttcctcttcctcttcttcctcttcataaataatcagacgaggatgataaaatgcttcgtcctttttggttttctctgatacgcaatccagaacccagtcaggagtcacaattttaatacttgctcgctttaaagcacattcgtatttctcctacgaggaaagcagaaacacacacaaaacaaagctgtaaattttatcacatttcctacaattacgcattttagaaaaaactcagtcaaggaatgcagttgaaatgttgagcaactattattacaattttatacagaagcaacgtttgatcttttagacagaggacatgaggcaaaagtgaaaaggaaccatacagcagtgatcataggaaggtctcacacctgtagcaggagtcttaaaagacttggctgaaaattaactttttaaaatgatattttaagtacaaaagtagagctagtaatcctatggaaaattatgaaatgaataattgctacctaagtttttactgattgataatatttagaagcttggttttccatgacagttagtaaagtaacagcgtggcagagtgccgccaatgcatcacgtacactcatggagcatggctgacttggctgacttgcataggacagctctattcaagatccagtatttatggagctcatgctatatgccaagcagcactaagggatggagacacaaaggatgcaacaagtctctgacctaacaaggctcacaatttggttctaaagagatattaaatacggaatgcaaatacaatataaaaccactgctgaatgatgcagtaacagactggaagggaatctcatcaacataagctggagggcaggaggaaagccccgttgaaaggtgagctttggctggggcacaaatgatgacaatttgcacagttagaatgaaagcagaaaatacagcccactggaaaagatgtgtccggagtagtatgttcggcaagctaacagagacctctcctgtggtaaagggtgtagaatgtggaaggcacaggggagggaataacaaagaaagaggaaataaataaaaaatgttaaataagagtaatatgacaataaagtaaccttaaaataaatgagttgtaaatttggctgtgctcctaaaagcttaacacataacagcaattctctagcaaacacataatcagggccctaaactaaactccgtgtcctgttgcagagccccaaggtggcatttgcaatttctgggtggaataagagtcacacgcaatagggatgcggggcagcagcacagagaggacagctgttggtcattcggtcctggcagcgaacgccaggcattgcccatctgggagatccttgcaaatagtgagctctgcacacagctcagtgacttaacttgtgtttgtgagtttgttctttctcaaacctttttaaaatataagaaaaacctagtcatgggagacacccatgaataagaagctaagcaaaggaaaatgaatgtaatcataatcacactgactagaaaggaccacgattaacatttttagggtatagtttaaatttatttttgttataaatatatatgtacatatattaaaagggcaaagggaaaaaacatatagtcatagtgaacaaatactttataatgttcctttttcacttaatatattgtgaacaacctcttcctatgaaaacatgtatacttttatgcttttgtttttaactttttaatgtacattttcgaacacagaccaaactttttaatgtacattttcgaacgcagaccaaactttttaatgtacattttcgaacgcagaccaaattagagactagtggaataaatcccttgtatctgtcacccagctttaataactggcaatcttttacaaatcttgcttctcctgaactttgtttacggatctcaaattgataaagactttctaaaccaccataattatcatagcagcacaatgaactatgattcacctcatcctcaggccctattcagatctccccagtagtctcaaaggcttttacagtttcctcttcggttgcacagctgtgtaccttagttcatcccccagtgttagccacgtggttgtttccagtgtttcactactatgaaaaactgcagttatattttatgacaaattcctaggttttggtgttgaggtttgaaaaggaatagatttaaggcttcatatctctaactacacttcccttcccaaaaaggctattccaattacacttccaacagctatgtaagagtacatcaatttacctataccctcgacaataaaatgtcttattctttaccctaaaaaatcatgctgttcttaaatatttaaaagcataaaatgttatatagctctccccagatgataaatttctactagagattttcaatttctggactacccattccagaaaaacccaagttattttaggaaaatatgaagtccaggtacacagcagaatatttatgaaccaattaatacaaaaatatcatctgcttgaataacatatgactatatgtaatatggtttacatatgatttttccaagttaaaaagatatctgttgaaatagtaaaatatgaaaaaaagttatttttaattgttttaacaaataccaaaaaacaaaacaaaactactgccatgaagaggagtcactgaaaattttggatatgaaaaagataatttcacacttaaaaggctgggatccagtaggctcttgagttcctagtttgtatagaatgctggcatttcacatttcagaaataacttgactatttcctgtggaaatctaagtaaaacacttaggtaaacagccttactatatttcactcaagttttctctcgcttttcacaagataggtagtttttaatcactgaaagacagtaactgtttaaacaaagatgatttaagaggaaagcaatgtttagatgcctttgcctgacccaatttatcagctaaattattctaaattttgtatcctcaaaacttctaactcactaagggctaaggacctcaagggtcaaccatgtcccctctccccaacaactaataaccataccccgtttctgttggttttaagttataaattctttcattcttcttaatttgaaacttttaaacttcaagagtataaaaggtagttttattaggccatttgcacaagcttttgctatgtgctcattaaagaaaacaaaaacatttactttaaaaagaaatgttatttttgtgtacagtcagctggtctctagcactcataaaacttacaaattagaagaaactatttaaattcaccactattaggtttacaaatttatgtctgaatagattataaaatacaataatttaaaggaatgataaaaattaagtctttttaaagggatttaatttttcaaatatttgtggttattgagttacataagccacaaacataacataatcgtgaatcaagaacataattatattatgttaattataatgtaaataataattaatataattaatataaccattttggttttataaatagactatgccagaatatatggttccttcagttcattttatagactggtgcttctcagccttcaaggggtgagttagaaagaaccagggaagaggcgaggtgaggcagggaacaccacgccatagaagggtgcatggcctaccaggatccaacaggaatgaaacactattgccttaaagacaacagacagacatgagcatgaagtccaactgtcaatttctgatcctgtgatcttggctgaaactaacgcagtgacactaaagaagagctgttaccactccccgaaattttggaaatttgtgagagcctattgtatttgtcacaaaagctggctggaaggaaatggttgagggaatgctaagtcctagaatgatcaagacaatgctgcatagtcgaggaattaccctacaaacattctggtaacgtaccatcagtcatattaaaaaatatctggaggtatgtacttaattttccagaaaaataaaaataaaaataaaaggaattatttctagcttattcaaaaatttacaagttagtcagttttttttttaattgaattttattggaaactgtcactaatggcaatgatcacttaccctttatgtcatcattacaacagatatacaacattaatctttttttcgcagccgctatattgatgactgtaatatataaaaatatatgcttatatatgttatacatatacaaatatcttttattttttgaagcagggtctcactttgttgcccaggctggagtgcagtggcacaatcatggctcagtgcagcctcaacctcccaggctcaagcaatccttccgtctcagcttcccaagtagctaggaccacaggcgtgagtcaccacatccagctaattttttattttttgtaaagatggggtctcactttgttgcccaggctggtctcaaacttctgggctcaagagacctcccaccttggcctcccaaagtgctgggatttacaggcgtgagccaccacttctggcccatgtaatatcttactacttcattgtcttctagggtagttatgcttgagcattaaaaaatcctggatgtttttcattattaattgctctctttctctttctttacatgtgggcattatgccttcttaaaaattaagggctgggagtggttctcacgtctgttatcccagcacttagaggttgaggtgggcagatcactggaggtcaggagttcgagaccagcctggccaacatttggtttctactaaaaatacaaaaattagtcaggtgtggtggcacgagcctgtaatcccagctacttgggaggctgaggcaggagaattgtgtgaacccgggagatggaggatgcagtgagctgagatcgcaccagtgcaccccagcctgggcgacagagtgagactctgtctcaagaaaaaaaaaaattacttaggaatggtaatgtgtacagaacggggttagagaaaggagtggtgggtgtctgtgtttcagtttcttcaaggggacagcaggacttccttcactgtacgccgcaagcagcactgtactggcacttagtaagtgctcactaatggctgcgtattagtgttatttttattactggcagatacaaaatctgcttttaacaaatatttaccattgcagaagaaacacagtaagcattaaaatagtagttcatttttccctatgttgaattagttcatgtaaaactgggaaattaaaattggaaaagcaaaaaaagagttatctttcttttccagtccataaatgaaatcaagaatgaagaacaaatacattacataagacaatattataattccaccattgacttagataagataatctctatatacatgcataatacattatatatatcacgtttagtatcaacttttaaaatatatggagtatttgctttatctaaatgtaattatagtagcatatttgttgtcttattcacaagcatgttttagccaaagaaaaatgatttaagtgcctctttgttgggataaataaagctcaattaaagtatttatatatagaccttatgacttagatttgtttttccttccaaataaaaattttaaaagattccatttttagctatacacttaaaaaattagtctaaagtcaataaatactttaaaatatatactctatcctaaagcccaaagaattactaaggatttctcatcaaaatattttggaaggggaaaaaacgctaaattaaggcactagaattaaaacgtcaaatcacaattcaaaaccgctttgacaaacccactctgttcacacagtgcctcttaaattgtcattctaaatcagtgaaaaaagctaaaggtttcatttccccttcaaattaactatgtaaaaatcaaatacatttttgctataaatcaacattaatgtaaaaagaacccactattttaaccaaagcatactgtttattacttaaactgtcatggaaaatatgttttttacttaaattttagaagtcacatgataaattttatataatgctttctatagaacagtggttctgaaactttagtatgcatcagaatcacccaccagaggacttgatcacacactgactgttgggctcatctgattaggtctgggaagaggctggacagactgcatttctttttgtttttttgagacagagtctcactcggtcatccagactggagtgcagtggtgtgatctcagctcactgcaactccacctcctgtgttcaagcgattctcctgcctcagcctcctgagtagctgggattacaagcacatgccaccatgcctggctaatttttgtatttttagtagagacagggtttctccatgttggtcaggctggtctcgaactcctgacctcaactgatccacccacatcggcctcccaaagtgctgggattacaggcatgagccactgcgcctggccaacaggctgcatttctaacaagtccccaaggggggcagatgctgctgatccaggggtcttacttgtggaaacaaaatccatacagccacaccactgctcaaggatgagagccctatgcttatcaagacaaaagtcattttcatatattccagattatgaagaagaaaatatatagaaaatttcaccacacacgtttataattatacctgatacaaggttcttaaaaaaaaatggtgacgggaactaaaaatacatttttttaacaaataaaaatgaaccaaagttttactggatttgaaaggaaattctacagattaataaaattttcctgttttccgcataaaatgaagcaaaatttcatagtatttagaagttatatttggcttacaatttacaatcatctcacatcgtttgtggaatgaagctggatataaataatataaaccaatataatcagcttttgtaaatgaaatataataactaatttaaaagaagctcaaaaaagacatgtgattactagaaattcttaaatgacatacaaaaagaaggtggcacaagaaacgcttaccccctttggctctggaacaatcaaatgcgtgcatttcttattgagggttagctggcaatctcccccatagaacgtaaccaaagcccacagggcacttctgtcttcagatgacacctgacagaaagttagaaagaaggcttttaccatacatttcaatctgtgcatggctatattttcactttagtaatatactgcaacaattctgtttctcccttaataaaattaacctaagaatatttgtagaaaaaatagagaagcttttagctatctgcttattataacaaaaacttcactcctatcataatagttttacatatatgaattacttatttttgccttgtcaccaaatgaatttaaaaatatttatatccacattccaaaaagtgaaatggaggattatttcagtctataacaaaaatagtcaggggaaaaaaagcaggaagaactagtatgccattccagtttccatttgtgtcacttttgaaaatgtttaaatacaacagcaatatcaaaatcgtattttaggaatgcctttatgctaatggataacaaatactaattatgaaatgaataaaataaaaataaagataaaaatatggtggcttgtaagttcaggggaaaatgtaaatattacttaacacaggaaagaaagaaggcaagcataaaaggaataattcttatgcttgctcagtgatgaagtaacgactccagatacaatggcttatgcagtcaaacaggctttcactgtaacaatagaaacagctaccatttattgcctgcctactatgtgccaggaactgtgccaagtgctttatctatacagctaacccttccaaccgccatgtgaaacaggaatcatccaccccattttaaacataaggaaacacactaaattacacctaataattggaaaagctgacttttaaaacccaggtctgtctacacccaggtctaactccaaactggactttccactgttctacagtgcttctctaagggcagttactgctgggaaagtcaaaaataatttctaaaaaaaatgaaattttagagtctgaaaagcaaaagaacatttaagaaaaataaaaatataagcattaattctaagataatcatttaaccgagtaaattttttctggataaatttattgtaagttgaggattatagttgttgaagaatcctgaactttgtctcgttaattttttaaaagtattgataatagcatgttaatctctttttaactgccagtatgcagcttgccaataatctagcattgttcatctactctcatccattttacaaacatttctagaaattattctgtattacacactattctatgaatattaacaagaacatgttagctttctaaaaaacacttttcaaatcattattttataacttgttaatttagtaagtcaatgtcacatttcagaagactggaccaggttatttttattagaggctttcacaaaaacatttatatcctgcagcattggagagttgagatttaattatatgataatacagattaatccaatgagtcattatctaatctttattaaaaatgaaattaaaaaacaatctagatatgcctttattaccaagatttgcctatctgttcagttaagtattattttattttactgactgcagtaaatctagtcctataccctatttggcctgtgtcacaggcgtagacctcaacagggtgcaggagattgctgtggaaagaacatcagctagggaggaatggaggagacctggcattaatacgacgcctccaataactcgcttatgtcaacttggaaaacttccatgacccagattcttcactgatgtacgtttggattaaatgactttgaacatccataccagctcatttaatgaatctccaccagcgtaattaagaatgctctttccacaccaaaatgttaacaatagttacttagtggtgataggattatggggacatttttattttcatttttatacttttctgtattttccaaattttcaaaagcattaattttataattggggaaaagtgcttttcttttttaaaaaccatctttccaaaataccaatgttatcatgttggctaataatgtctcctcagtgctgcaaggctaaaatccaaaggctcccccatagtgtccaggcccttcctgtctggctgctcctaaccacctcctcctgcccatgagcactgcccccacgtgcacctgccgtcctcaccacgttctgctttcctgtgccccgctgcgcccaccctccgacctcctcctctaagactcagctcaggtggcattaccactgtactcccacagcaagctggacagaaatctaaatacttctcacactctacaactatctgcttgcttatctgtcctcccagctatactccaaagcaaccaggagcagaggactagaatttcaagtctgtgcccccaggaataaaagctttcctttaaaccaatcaggaacactctcccttttccttcttcaggcctcaccacccccaataagacactccttgattctagcttacaggattttctccttgtccagtcttgactatgaactctaacactccttcttaaagagtcttacatgatgtcctaaacttctctgagatctttcacagcacctagtacagtgcaaggcacatgggtaggcagtcaagaaatactgttgattgagatacagaatggaaaggactttttagtcttctagattcaaatcatgacctagccaggctctccattacactcttgacctattccccaaaacctacccagcacattacaacagaggcctcagcctgcatcaataccgggtcagaagaaggcagatgatctctgtgcttcccaacttctgctggacaagctcccttccctacctctccctgggagagctctggaagactccaacaaagagctccagcttgtatcaacaccctgacggggaaaagacagaaggtcactgagaaccaccaagaaacagtccttttgtaaagctggggtcctgcctggcgtgtgcatgtgagtgtgtgtgcgcatgggtgctccagtgtgcagaaaaggtgcagatccctctgacagtctccaatcagttaggactaaccactgtgagcactccctcctgcttctgtacctggtgcccactttcatttttgcatatgttgcaacataccgtatttgcccaaggcctgacccctcctagactgtatgtttactgagagagaaatcgcatcttaattaatttgtacccctctgcattgctcctgtcacaaaggaagtacccatcaaggatttgttggaccaaagtcccttagctgcacactgtacatatgttgttaatgtatcttacaaccaaaataacattttttagcaaccacaaaatattagtgctcccaatgcacttttcttaaactacaatttccagggtttcttcatagaagtgactattaaagtcttccccatccctatttgaacaatctttctcaacttaaaagaaatgcttttattttaccccatgacacactggggattccaattcatcacgctaagtgatgaactgcgggaagtacagtaagtgacccacaaagatcatgctatttctggattctgatttttcttatccactgaatttgctaaaaggatataaaatactatcaaagagcttgctaagaaattaaccttttggccatcattgacccagccactccccttggtaagtttagcaccaaggtaaaattggacctttcacctgacagtgggtgagcagagccccttcccagaacacacaatcaaatgacactattccactgcaaagaatcaagatattcaccttctctgagcagtctgctcacctagttgtttctttatggatatccatcctcctatccccacagggactacactggtgacttctcagctgagaatccaagatctacttagaccccttagcctgtgtgatgctcactgagccagctgatactcctgtatcactttctatcatccttttcctcctcttcctgggtcacagaataggactcaggatacacacaaacctatgtacaactatcttctaccaatttatgctctaaatctttacctgggttgttgttatttcccagcaatgaaaataaaaatgattaagtgtgactttaccttggtttctaaaaataacgtcctcctcctccagtatcatctctgttttcaagctccttctttttttcctccccaaatctctctaccaatgcgtgctatccaaggctctactcccagttatctgctcctctctctatcatgctctgcaggaatctccttcatgccacagcagctccaagttcctacacttccataccttatcaacagcccagagtgtgtttcaaaccagtgtcaccatctcccctcgccaatcaggctcctccctatttcccagctccttcagcggtgctgccactttcctgtgctcctcgactgaaacaatgacataatctttggcatccaccatgggatctggcacagggaggtatacagtgagtgctggcttctcactctttgcaccacagcatcccatgtccccaatacctgctgagtcccatctgttgctaagtcccatgttgtatctgctaccctgaatcccatctccatttgtcaaaactccagcctctgtcctgccctgcaagtcatcctcagagctcctggaccagttttacctgcaatgatcacaagtgattctaattttgtttgacttttggtttcccaaattttctgaggtaagtatttgtaatccaaaatcaatgagaaaaaaagggtgatgaagcatcctgctacctactttacccagttcaaactcatataccttggtttcccatcgtctctatccatctacctgcctgaccattttttcttctacgtgcaaatgcacacccttggttgacaccagtctcctcttatctagcctctgtgtactcctgacttctccttccaccttgctctatgcagaatgccctcctcccttcccatttcctccaattctgtccattctttcagggccactcacaccttacatccactctgtcaaggcttccctcgcctcgcaatccagaccaatgccatccttcctaagctcatagaatcatacctgtggcccctgagtggtcatatatgtatcatgtatgtatgtctacactataacctaatttattacatgtataatataacaatttgttacaaatataaactctgttaaacataactattagttctttggaagactaataatattcttttgtgctaaactcatagttaatatttaacaatatctaattacctcatttgaaaccctataatcatcttatactcacatacttttgattttcttatttatttcaccaaatcaagtcttcaaaatcccatgtcactgtgaccttcatctctgaaaaatgcccataggactccctgtccctgtcccaaactcagcgtggcccttcgtcctctctccctttctcattcaattggaatcatttctggatagtcggctctgagtctctgaaacccagaaatccaaccagtgcaaataaaattaaatgaaaaattcacattttagccaaagtacattgtgtttatacataagtagtaatgctttcatttttaaaacttttctgataagttgattgtaaatttggaacatacagagaagtagaggaaaacaataaaaattacatgtaaccatagcacccagcatttcttttctcattttagccaactttaaagatcattcatgtaaatatacacttataacagatatgaaaaaacattgcaaaatacaaataccaacaaaattcctgttaaagagaaaaaaataagccaattttgctacttgaaggatctccatcaaattaatgtcacaaaaacaggattttagagaacttccagaatacaagagacaccaacaaaaacacagtaaccacagataaatttacttattacttggacagaggatggatcaagttcagaccggtgatatcctttgtattaactgttgagtctggccaacaacctaacaatgctaaaccaaatactacccagctccgtaatcctctatcacaaaggcataaggaaaagcaagattataaccaaatttctttccatcttacctaataacttgaatgtgcccttttctcaaaggtgtgcacagaaaaagatgactaaatactttttcaaaagtatcacctatgagcaccaaaatgacagcctgggatgaggactgtcaggtcaaataagatgggacatcctacagtgcactttcaccttcctaaggaccactaattttaaacaaattattccacgtaatttgtaaaacgactttaaacaataacaatttgatttttttctaatagtttttattatgatttgaggtttttcttagctgggggttagaaaaacaaaatacaatacaaaaatattaaatattcagatactcagaactaaccactgttaacattttggtttctcatttcagatattttatctggctggtgtaatattgtacatacctaggctatggcctgcttttgccacttaagacgtttcccatgtctttacaagttttcataaaacagaattcaaaaatggctaagcagctagactactgtgtaagtatatacaataggtttcttaaacattcccaaatagtggatgatccgattgtttccaattttaccatcttataaataatgcttatcaataaatgtaggcacctttatgtgtcagtctgtccttctatcgacttgggataagtttctctttttttttttttttttttttgagatggagttttgctcttgttacccaggctggagtgcaatggcacgatctcagctcaccacaacctccgcctcccaggttcaagtgattctcctgcctcagcctcccaagtagctgcgattacaggtgcgcaccaccattcctggctaattttgtatttttagtagagacggggtttcgccacgtttgccaggctggtttcaaacccctgacctcaggtgatccgcccacctcggcctcccaaagtgctgggattataggcatgagccaccatgcccggccgacttgggataagtttctaaacataaaagaaatgcaggtgaaaacgaaatgagtattttaaggcttgacactgctcccctttcctaggaaactgctgtactcccattcctgccggcaggaagcaggagtctgtcctcagcatctccaccaacactgaacacactgttacaaattcgatgagcaaaaacacttatctcattgctattaaaatgttcatgtttgattataaactgcatcaaatgttttgttacacttattagtaattcctctttatagattctaaatttgtttctctgccttatctgctaaggtcttttttattcttgttgatctgtatgatccctttatttattaagaaaattctttgcctgtatttctaactgaattttccttgtcatcttttaatttcatttttaatattttttcatattcaagttttaaatcttttttatttataaagaccattttcacccattaaaaactttaaatcttaaaagcaagcacaaatatttaaataattttaagtgtcatgagtttatattaaatacacagtcagtttagaaaatagcttctctaaaactggttaacaggtcataaatccaaccatacaaaaactcagaagtgtcacatataaataactcaagactaactgtaaccatgcttacctgagaaaggcaggcagtgattccaaaaaaaatctgacatgattctggagaaaaaccatttactctgttttatagttattaagattacaatgaaataagattagtgcaacctgtacttcactaacagacattacccacccactccgtccccactcagtccatttaagaaagagacagacttaagatagacaaagaagagtacagggcagagtggaatagagagtagtgggtggcacagaaagaactgagtgcttttctgtaaagcacattttgaaatccaatctctccacttatatcataaatcaaataggcaaagtatactcacagggggaagccttttgatctctgatagctagctaactatatacaaatatataaacacacacatgcctatacacatacacacaaatggcatagcagttattttaaaagcaaaattaaaacgtcttgtttcttttagattgaaacgttgtgactgcttccactgcacagtaggaagaatccttcataagagcttgattgagctctagttttattatctccgctaactttgtgaacttaggcaagacaactgtgagcttcaatttccccttttttaaaacaaaagttggaatatatgattccaaagatccttcctatttctaaagctgatcttaaaaattcattcaaaatgattaatgagcacttactacacatcacacactgtgaatttaacaagacacaaggcagtcatgatctctatgtgcctgtaattcatagtctattcagagcaaacaatgactttttttgaataatttggagtgtgtagaattcaaaatgggttaaagtattacttctctttccctataggagtaaagtatactgattgagataggtgaatcaagaaaaatatcagcttaaaaattctattccaagtttgaagtctcctatatggttacacagatgaatcctataaacatttgagacttccctggctgtaaaaaaaactctgaagactgcaatgataccttcagccccattatcgaagatctgtttccatcttccaacctaagctcatggattttctacttccaaagacttggggaaatattaataaaggcaaatctcagagtgcactgtctaccagtgagtctcccaggctcccttgtttgtttgtttgtttttgagatggagtcttgcttttgtcgcccaggctggagcgcagtggcacaatcttttgttcttatggataggcaagtaagagctcaaagaagatcccagtggctgggcgcggtggctcatgcctgtaatcccagcactttgggaggccgaggtgggtggaccacaaggtctagagactgagaccatccttgccaacatggtgaaaccccgtctctactaaaaatacaaaaattagctgggcgtggtggcgcatgcctgtagtcccagctactcaggaggctgaggcaagagaatcgcttgaacccatagtcccagctactcaggaggctgaggcaggagaatcgcttgaacccaggaggcagaagttacagtgagccgagatcgtgccactggactccagcctgggcgacagagcaagactctgtctcaaaaaaaaaaaaaagatctcagcttcttaaggagtcttgtacagagaataaatgacctggaacaacaaaatcagcctcttagctctattcccagtctttttgacttcttataaaagtaataaataacgacaaaacaaaaacaggaactaatttccttcaactctttaggctatgtacaagaaaatattagaacttctgagttggagttgctaaagttctacacatcctccaagaagaactgcttgtagaggaatgttttccctatttctctataaatatttcatgataagtttccttccatctgcattgattcaatgggtaataagtgctttcaagagaactgcctggcatagctgcaaaataaaatagagcacatgacataatctcttgccaggtctaaaattttagcaactgtatggtatcaggtacttgcaaaagaaatgatttccacaagcaagttacacttgaagtaacagtcccatgaagaattatccttttaggatgaaaagggagccaccaggcctagaagagtaaacaggaggcctgtagaacgcctcatttctgactcctgacacagtgccagggcaagggcacatctatgaatgctccatgaacgaacaatgcaagcaaggaagctccctgagggcagaaatggtcttcttcacccctctattttcagtactcaacccacagcacaggtgcactgaattaataatcgttctacccaatgcaattaaaaggattaacaatgcatgttataaattttattctcatgttctcttccccaacttactcttcaaacaattcatgatttgattcacatagacttagaattttagaaatatccctcatctagctagcaccacaaaagctgaagagaaccggagctcctgcctccagttcccggcctagagttacttgtcacagctgagcccccttttaacatgagtaataacaaggatcaggtacataaaatttgaaacaggatggaaaatagtaggaatataagatgtagacaaaacaatctgtcctaacgaatgaatccacttttcactccattaactatcatttctttcagtcttaaacccagagttaccctttccctcctcccccactcaaaaaaaaggatacggcagaagagttccacactgaacggacagaatcacccaagaaggctgaaaaagaaaagattaaatcaaaaagtattctcaatttacaagtggcatattattttactagtgttgttcttagaaattaaaagtctctgttacaacctattttaaaacatccagattacaagtatgaatattcaaatagaaatattatagtcaaagattagttactaatacccaagatgaaaaatccaattacagaatgaagcactaccatatttttttaaaattatgtataaacatttaagttccaggtttacacacttattactgctgacccccacatttaggacaggggaactgccacccatcctgccccaccaccgccgacacctcatccagggcatagtcagcctctcatacgctcccttcttgaatcccaaattcagtcaagtctaaattcatgaggtgtttgtttgttttagtgaagtcaagcagatacaatgtttgtaagcctgaaaatatttttataaattctaaaaactgagattaattataaaacagattaattactacctttctgggtaatttatatttttgaaaaattatcttgtttctatgtttaatttttataattatacaaatcattctcctgatagctctacttcagaaaattactatcaaaatgtagtaatgcccccattactacattctggaaggcagctgacttccagaaacttcagccaactgaaacagacatatatactcactacccacccatcaattcattcatcaaatatttattgagaatctattttatgcagagatggtgcaaggcgctggggatgtaacaatgaaaacgagaaacgcagtctttgctctcctgcaagtcatattccaagctaatgatcttcaagctatttttgtcatgtacaccttaaataaatttcagacaatgaaatgccccccttatcattttttagatgacatctaaaatttttcagcataactctaaataagtatattttctgtgagaagaggaatattaaacattttataaaataaaataaagattggcagctgtgcctgggataattacttcattatgatttgacatttaccaaaggttttaactaagttactggattagttatctgaaatctgaaagaaggcacttaatttttcgatctatgtgccttatccaacatatcttcacattttttgatagtcctagaaaaattccagttaaatttaaaaaaatgggccagcatcaggaatcggtattggccttgacacttctgaattcagaacaccttcatgtagaccaagctctcctttcaacagcaacacccagaaacccctctctcctcatgatgccatgactgagcactaagggaacagtccctaaaaccagtctttctaattgtccttttgtctgctgtccacgagaattttcagagcctggggcaatgcactacaagattaggatgggtgaaggtctgattcttcctgtgtaaagtgggaggggccactgtgaccacaggtgtgttctcaggcagctttaggaagggccagtctggaaatgttatctatcaccttacaaccatccacacagcatacacgctgaatatctccccccagggagcttgggtagggtatcccagtttaaagactgctggctatcataaagtcccatccaagcacagtagaatcactgaggccctacttcagataagtttagataaaataatgcaaaattaggatgtaggccacagtacaaagcagaaatggagaactacaaaagcaaagtgataaggaactatttatcctaaaggcaaagaacaatatataaaaataagctggctgatcgcgatggctcatgcctgtaatctcagcactttgggaggccaaggcgggcggatcacttgaggtgacaggttcgagaccagcctggccaacatggtgaaaccccgtctctactaaaaacacaaaagttagccgggcgtggtggcacacgcctgtagtcccagctactagggaggctgagagaggagaatcgcttgaaccctgaggcagagggtgcagtgagtcgagatcacaccattgcactccagcctgggagattctgtctgaaaaaaaattaaataaaataagcccactacaagtcagcaaaattaacatttccaatgatgcccaaaggccactgagaaaaatatctcaatttaaaaaataattttaaaagttttggtgcccaaagaagcaagttttaaacatttataagattcaaatatgtaaatgatagataaactgtcactgtgtataaagatgccttatttttaaaatgcattgtcaaacttcctatcaaggtaaaggccaagggatatgcctctagggaaccaggtctcagccttcagtcatatgaattcagactcaactattagcagcaggatccaaaataagacaggcccataaggttcaaactaagaatatcaggatctacttgaaatatcttagagtgaaggcaaactgttgagtcagctccgaagtactctaccaccttgtaatgtaacacaatagtccctggacaatacaggtgctgtcaaaaattacaagcaggctggaatgctactgggtacagatgaaatatgtctgtcactcattttaaaatactatagccagagggggaaaaagttgggtttgaatacagtaaactaccttggcaaaatggtgataatcctagatgctaactgctaattgtataagtaatgggtatttctacttagccttacatactgactttcccaggaatatgaatactgtgtaaaatgaaggaagactgctttgtttagctcaggaattgatcaccattctgaaatgtcacctcacagcggcgaccccacttgtggggtatgatatcaatctgtaattgcagcagctaccggcagtgactctacatatagcagcagccatgcccaagtgtttacacattgaaatatatatttattatttacttgccttttatttcgccttcacatttcagtttgggcaatttatatatacatattttaaaggttggcttacgtatcgattcatttctggataataaggggagtgctacaaagtacttattacaaaaaggtggtttggggtcaggcaggtttaagaactacttctggtagttggcctggcaacaatcacctaggccccaaggatgtgttagaaagatcaccctttcacataacatctgcataagatatgcaaagccgctttactgagacaatagctccaggctattgtctgagagaaagaaagtttgtaggaaggagaaggaagagacagagatactgtccctaaagcagtacaaggaagcaagccagagacaaaaacatgttccaaagaagagggtgccccagctcaggacctcatccaaggcagtttccgaccctgggtaccagggaggtcaccacttcccagcagccaggtggcttctctggccccgcaatttgacttaatggcaatctttctatttttttccctttttctttttgtttaagagatggtgtctcactgtgttacccagactggagtacagtagctattcacaggtgtgatcacagtgcatggcagccttgaactcctggcctcaaacaatccttccacctcagcctcctaagtagctgggactacaggtgagtcccactgcaccaggctggcaatctttcttaattcctaacactgttattgttaaaccacagtaactttcatactgatttctttttaaggcaaagcatttaataacatgaagagggaaaaaatggtagtggtatagaactattttaaaacaaatacttcatagggaagatctgaaataaaatcgaagcattggaattacaaaatttaacaaatttttaaaacacacattttaacagaagtcaactaacttatcagccataacataatacagtaggtggataaacaaaatctgaacaattcttccactagctgaatccctcattctctgcaataaattacccataggtcaagttggatacaccccagacgaccagtgggtagacaatgtgactaaaggccattgtgactcttgtcagaaaggagttccacaacatagttaatgggggacgcccttcagctaactgaaattcagaacaccttgccacagtcgggatggaaagtaaccctgtcctagagttacctcccgacaggccttagcctgcttttggaatgaaatacactcttacaataattcaaacacccatctgattcaaggcatcagatctgtttcccatgacaggtttccctggctcagaaaacttccaggcagtggtaacgtgggacgagttctgcagcaggcataaaggatggcctaggattacttacgacatacagaagccatgctctaccttggtttagctgaaaggacctgaagctaagggaagttactcagacgttaaagatgtccacagttatctggcaactttccacacaaaacaggactttagggccagcacggtggctcatgcctgtaaccccagcactttgggaggctgaggcaggcggatcacctgaggtcaggaattcaagacaagcctggcccaacatgttgaaaccctgtctctactagaatacaaaaattagccaggcgtggtggcaggcacttgtaatcccagctactcaggaggctgaggcatgagaatcacttgaacccgggaggcggaggttgcagtgagctgagatcgtgccattgcactccagcctgggcaacagagcgagattccagctcaaaaaaataaataaataaaaaataaaaataaaataaaacaggactttagcaaaaaccctgaaaagagctatagtgaaacttcaatgtactgcttgcaagatactgaggaaaagatataaaacaaattatgtttactactgacctttacaacaggtaagtcaaagacttcccgagcttctcccacctctggattgtccccatcctctgagattatgtgtgaggctagtgcattgtaggaaacttccttcgcttttccagccttgagaagctgaataacctaaaaaacaagaaaatccacacaaattaaaatgggcaatactgtactgtactcttgaattacagaaataattattgggcataatagtactttttaataaaaacacaccatattccccacataaaaactaacagccttttactctgaataatatgccaatgaaactttcggggacaatcaaaagcagcaaatcttgattcactgaccaagtcaatgaccaagtaatggaggctattgtgagtccagtagtggacatggtctgtcctcaagacagatgggctggacaaaccaggagacagcacaaccactgctgcggtggggccacgcacatggtgctcctgagcttccaacttaaagactgggacatggggagtttcataattagggaaagattctggaagacaagatatgtgagcagaaccctcataaacgtctgggtgttaggcaaaaatccatacatcgaggaagagggagcagtgttgaaggcactgaacaggtgaatacagagcagaccgtaaatgggctttcttacacactatgcaaaaaagtctgtgcttcattctggggtatatgcagggccactgaaggatttcacacaggaaaagtagcacagatttcatacaaagatgacagtccatgtgaaaagaaaggattgggtgggctggctgtgtttggttggctagatgactaaagacaagagacctgttaagaaacaagtgcaataacccaggtgaaagaggcatccactaaagtgatgtcctgatgggcagaaaggaggaagatgtgagagaatcggcaagccttggtgtctggaaggggtataagcaaaagagcaaagtccagactgaaatggtggtgagtaccactcactgaggaacacatcagaaggctggcaggtggggacacaaggacgtgttttagtttgggcatgccattctttgggggtcgtgttaatatctggcaagaggcatccagttgcagctaggaaaagatgtggatctccctgacagaaagtcatcagcattgttacatagatgggagccacagccatgagcgtgaaggtggtcgcagtgcagaatgggaggggagctagagagcagacacagcaactgatacttcagggacaggtagggaagtgcagtatcacaggagaggagcgtcaacagaagccaaggaagtgagggttaaggaacagtcgacagtcaagtgcttcagaagaggtgggcagtgtctaagctgacagtgcacaccaactgtcaaagtgacatggtgcccacaaagctcaagtgacccaccagggcaacgctcttccaggtcccctctctgcagcagagagctttcttctttcacttattaaacttttgctccaacctcaaaaaaaaataaagtcacccacaagctagacaaccttttcagaatactttaccgaccactaatagatatgaactagagcagaggctcaatatttagtaagtgaaaaaacagcggtcactggccatgggccactttacctttcttccttcccttgacctctaagcatttttagcttcacgcatccattcgactggtcttcagaaaaggcacccctccttttcctatcctccagtctgtttctgatcctactcccttcttcatgagtttccctgtccatagctatgttccctccacctgtaaacagtaaagtcacccacatccttccacgcgcttgtgatgcaacacagatccctccccagccctctcttcctcaggcaccttctctatttccttctcaggacaaacttcctgaagagtctaacctttctgttctcagtttccattcactcttcaactccctgcaatccagccccttccaccaacactctaccaaaaacactttactcggttttcacgaactttgaggatgccaaaaccaatagcttctcttcaatctccacactactgagtatcttaatagatttatctcatatcactctgttccagatatagtgatcatcctgatgtatcccaaacgcatgaatgccttcattcctcagcacatacgctccacatgaaaatattccttcatgttcttaacttctgcttatctcaaaacccaactgaaatgacatctactgagtgacatttcagtggtgtctactttgcaccccagtggagaaatctgctacaccttgtactgtgatatgtccaggtgtgctccctcccccaccaatgaggggcgctaaagggcaggtaccatgtcctcttcacctctgtattatacctggcacctagtccatgcctgcctcatattagatggtcaacatgtgaacttataatccacagtcataagagtcagagaatcagatgtccaggctcaaaacttttcagaaaatatactgtttcagatgaaagtggtttgccaaggacatttttaagcacttagatttgattcaaagtcgagtaaatatggttccagttcaacttgttccaggttttaagtaacatttggttcaagtcccctataagagccaaagtcctaaaatgaaacacgaaggctaggaaggagggggaagagaaaaatggtggatagcaaaaaacaaaaacaaaaaaacaaacaaaaaaaagaggggcgggggaatcatcaatactggaaaaagctaacactgttacaggcactcatcttcatcgctccgtgttcagcaactgttttactctgtaaattcaaagatagaaggctttttttttttttttgagacggagtctagctgttgttgcccaggctggagtgcagtggcgcgatctcggctcactgcaacttccacctcccaggttccagcaattctcctgcctcagcctcccgagtagctgagaccacaggcgcccgccaccacgcccggctaatttttgtatttttagtagagatgaggcttcaccatgttggccaggctggtctcgaactcatgacctcaggtgatccacccgccttggcctcccaaagtgctgggattacaggggtaaacccggccttgaagtctctttaccctaaagttacagggcaaaaagggtccaaaaagttgttacaaggacgaacctcaagaaggccaagatcactcagccttctacaattccttctacaccatccaagttcatctgcgaaatatgagtctccgcccttccaggcctaactctgatcactggggatccccatcctccaaggtgggggccactgatgtcacacccaaggcaacacaactgtacagctaaacttttaagaaggaaatattttgaagattaacctgaagaggatattcaactaagatgcattcctaccacggactgataactgtgtgacatcaaacagatatattattataggaatactaaggaaaacccacaatatcctttggcgtgagcccaaactacacaaaattaaatgtgtaatgtgatggtgttaccagggtaccgtaaaattaatcgtccaagtgggaaaatcaaggaagacgaatgccagcccccacgtgcagggacacaggctggaagggagcgctcctcagccccgcacaggacggcagctgcccgggtggcggaggcggccaagccggtgcacggccacgacccccgccggccgagcgaggctggggtccccgcgcgagctgccccggctggggatcccggcgcccctcgtccgccctcggagctgctctcccgggagccgagacgcccggcgcggggaatggggagacgcgaccccgcgcccgtcccgctcagcaaaggagcagagaacgaggcggcccggtgggtcgggggcggcgaccccagggccgcaggccgggggctcagggcgcgcactaggggccgaggtacagagccccagccgccttccctcccgcactcccccgggcccgggcctcccgcgcccaccccgcggtcgcccctgccctcagcgcagtcaggccagcggcctcggcggacccgacgctctgcgcccggcgcgcgcccgcggcaggagcggggacggggacggggacggggacggacggggacgcggacgggggaggaggccgcggcaggggcgggcgcggtacctgcgggtcgatgtcgcccaccgcgtaatacttgacctccctgaacatctcctcaggaactttgggcgcctggtccgacatgatcgcggcggcccgggaggctccgcggcggcgcccggccccgcccaccccccgcccccggcccccgcggcgcccggcgcccccactcgccccgccaacggccctgcccgcgcagcccgggcccggtcctgcgaatcggggtccgctcccccgccctccgcgcccccgcccgcgcccgcgccgagcgcccgaagcgcgggagccgcgcgcgccctgcgggacgcaccatcccgccccggccaccgagggggagcgccgaggagccgcccggcctccagtgacgccccgcgcctctgccgccagccacggctccggggtagctggcgccggcagcccgctctggcccttgcggttccgtggccgccgctctgcaacgagggggccccgaggacgaggggaaaccagctcccccctcggcggggccggagtgagccggtcccggggaggaggggagctggcaggcccctcccgtcgccacatgcggctgctcgggggcggcgcatgcgcgcggcggaggggggggtggggccttggggccgcgagtgggagcgggagcggttctgcggcctcctcgggcttcttggccctgggcggagtgggattgggtgtcccggctgttcgcagtggccgcgagtgcggccggacctggagtagtacctgagccgctctggccgagcaaggcgcggggccccggtctacaccgcgctggacccggctatgccgtgacggaattcccgaggccgtagcgccacgcgagacgcgcactggtggcctccgcggcgagtcctggggtctccgcaaggcctcagtgcccgagctggggacgtgctggggggaggcccggccccgtcgctgcccgaggccccgctgtcccggccggaccggcctggtccctggcgtcctgtcgggtccgcgctggaggagagtcccagacagcagagcccgcggtgcagctccagccccgggaagccccgcgctcaacaggttaatactacacagcggcgattctaatggtcacgcttttatttacagctcgcctcccttccgccaagattcacagaacacggcagagtggcctcgggatcacctgcccaagacacctgcacgaccggaagttgggagaagaaattaaggccatgatgatgaacgcagcctttctcgtttatttccaatcccacaacaaaccggagtccaggaactcatgggtgattatcggactattacctagtcgtaaaactgtggagcattggtgtctaaaggaatctgagacagacccgcagtgtctcccccacatgccttaagtcacttctgccaagcagaaaatcatttttaagtaaatgttagtgaaattggttttaaaaaagagaaggggccgggcgcggtggctcacgcctgtaatcctatcctttaggaggccgaggtgggcggattgcctgagttcaggagttcgagaccagcctgggcgacacggtgaaaccccgtccctactaaaatacaaaaaattagccgggcgtggcggcacgcgcctgtagtcccagctactcaggaggctgaggcaggagaatggcttgaactcgggtgggggaggttgcaatgagccgagatcgcgccgctgcactccagcctgggcgacagagcgagactctgtctctgaaaaaaaacaaaacaaaacgagaaggctttcaaaattactctgcggtacactaatttaacagattagatcactttccaggctttaagttggcctttgttctaccctttttttagtgtatgataaaagttgtgttggttcgttgatcagcatgcaatgaactctggctcttgttaatcaggtgactacagttttgtccttacatttgtatgtatgtcatgagtggttttgtatgggcaggaggtaaacaacgcacatttaaatatacttaatgatttatcattccaatgttttctggttgttttagtctttcatttgtctcttgaacaatctgaaacatccctattctaaggctaaaaaatttcctttacaaacttaggttaaacattcctaatctgaaatccaaaatgctctaaaattcgaatttttttgagtactgacgtgaccccacaaatggaaaattccacacttgccctcatgtgacactgggtgacagtcaagtcacaatcaagcctggtgtggtgggcacctgtagtgccagctactcgggaggttgagcaggaggattgcttgagcccaggagtttgagtccagcctggacgatatagccagaccctgtctgtaaaaaaacaaaaaccaaaacaaaaaaaacaatgaaaacatttttttttaaaacgccatcaaaactttgtttcatgcacaaaattatttaaaatatataatataaccttaccttcaggctatgtgggtaaggtaaggtgtatgtgaaacaaatgaatttcccatttagacttgggtcccatccccaagatatcttattatgtatatgcaaatattccaaatcaaaaatatctgaaatacttttgtcccaagcatttcagataaaggttactcaacctgtaataaaaacactcagtgcttgcctgaaggaaaaaccaagaatttgtcatccatccttaaatttttatgacaccctttgtaatcaggaaaccttttaatacctaagaatatatttgatatattctggtatatgtttatcattctgatgtttaatgttctatgttgggcatatatcagtgtaataaatacattagatccaaatacagatcatgctgcctttttatcgacctgtgtgagagaacttatttatccttttctttttctttcttttttttgaaacggagtcccactctcacccaggctggagtgcaatggcgtggtctcagctcactacaacttccaccccctgggttcaagcgattctcccacctcagcctcccaagtagctgggactacaggtgcgtgccaccacacctggctaattttggtatttttagtagagacaggttttcactatgttggccaggctggtcttgaactcctgaccttgtgatccttctgcctcggcctcccaaagtgctggggttaaaggcgtgagccatcacacccggccctccctttgattttcttggttaaacacaaactaagcatgtgattttatgttaaaagacctgaagtggacctcaaccaggtattttattttgtgaattaagaaagcaatttgtaacgttcaagagaacaagcttaccctacttcaggttctgatggtaaggcaaattgcgggattaagaaacctgctatttaaggccagcgtggtggctcacccctataatcccagcactttgggaggccaaggcaggcagatcactggaggtcaggagttcaacaccagcctggccaacatggtgaaagccagtctctactaaaaacaaaaattagctgggcatggtggcgtgcacctgtaatcctaccttcttgggaagctgaggcaggagaatcacttgaacccgggaagcagaggttgcagagagcagagatcacaccactgcactccagcttaggtggcagagtgagactctaaataaataaataaatctgctatttaaaaccccatcacctagtcagtatttgtaaaatatcacacgtgaactgtgcaaggcggtccacacaagtggatcttacggcaacagcatcaggaaggcctggaggcagtgtcacactcactcactgagtctccaatactactgcttggccagtaatgaaaaataaaaatgtttacattaggttaatttcatgtggataaaggatgctctgaggcagtctaaaaaactagcatcctgacatcatgaagagtaacccatctagcagaggacgtaaagatggcaagtcaatatttaaaggcaagcggtaaactcagaaattatcttccccaaaatggccatatgcaaagttataggaacaaaatatcatgttgacagtgctgtatcttattcacagttaaataaaattcttatcactggttttgtgacactttaaggatgacccattttagggtgatagctatcagtttattaaacagaagctatgcatttgtttaatttgaagcatataccacttccaaatatgacactgagcattaatatttttagacttcccccaggtaaattaaaagcatgatcattttgttgataatcagcctttggagaattaaacagcctgcttactgccagtgctagttcagtaaatatgtttctcattttctatttggcaaaattagataacctaagcctaggaaaaataaaaaattagaaaaaaaaaagtagatttggggatatttaactcaaattgcccttactggtggaaactcgaggcagttacttagattatttccaaatggctttttttaaatgtatttctatattgtatacaacagtctcagtcttcatctctcctgttcagctatccatacatcccttaaaattagatatttttaatgtttagtaaaccttcagtttgggtttatagacaacatttaaccttctcatgaaagggtcagaatactccagttgcaggcacaaacaggccatagtttagttgaaggagaaactgcgaactcaaaggagcactgcttctctgcaggaaagatcccgtcagtggacctgcggggcacagctgccaccagtgtcatgtagctattcagtgtcggaaaactagaaatcacaagtgaagagaaattgtaaattacctcaaattctatgcccagaagcaaccactatggaaatccttctagacattgtcccgtataaatatatttccctaaaaaaaattataccccatactctgccacttcaaaaaaatcaagactgtttttccatgtcaataaatatctatatcatttaatgaatacataatactcccttgtttgaatgtacaatattctgtattgttgcacatttgttgtttccaatttaacaattacagtactccaatgaagcaatcatcttaaaatacatgtataacgtattataatgttccatcctttaaggttagaaacgacgtcccatacctgtctcccgtcactctgagaacagtgcggtaacaggatcagcgattctcaaccatgggcaatttagccccctatggcacatttgacaacgtctggagacatttttggttgtcacaactagggggtaggggatgctactggcatctagtggtggaggataggaagctgctaaacatcacgcaacgcatgggaccgtcctccatgacaaaggacccgtgcaaaatgtcaatagtgccactgttgagaaacccggattaagatcatgttgtaactacatttcagtgggataagactttgaaagtttccaccgggcacagtggctcatgcctgtaatcccaacactttgggtgcccgaggcaggtggatcacttaggtcaggagttcgagaccagcctggctaacatggtgaaacctcatctcttactaaaaatacaaaaactagttgagcatggtggtgcgcacctgtaatcccagctactcgggaggctgaggcacgagaatggcttgaaccggtgaggtggaggttgcattgagtcaagattgcaccactgcactccatcctgggtgacagatctagactctgtctcaaaaaaaaacgaaaaagaaagtttcttgcacataacgccttggtggcttccttcggacagctttcttccaaatgggacttggcttctgtcatgtggctttgttagctgtacagatggggacaaagcatgtagagtatcctgctgcagtttctatggctgagctagcaagagtggcacacatacctccagccatttccactggccagaacctggtctcctgacacctccgtaagctgtaaaggagactgctgggtgatgtggtcttcttacacgtccaagaaaagaaaatggcattgatggtatcttgccaatttttgccatttttggttttcaaaaaaattcttatatgaattaagattagtgtaatataaaacaaaattctcaaagataatttcaaaaaaaatacccgttagctactcaatagatatttgttgaatttgaggttactggctttatacatagaggattaagcgtattctttttcccgcctggccaaatggtaaaaccccatctctactgaaaatacaaaaaaattagccaggcatggtggtgcacgcctggaatcccagctacccaggagactgagccacaaggatcgcttgaacctgggaggcagaggttgcagtgagctgagatcatgccagtctgggccacaaagtgagagtctatctcaaaaacaaacaacaaagaaacagcattatttttaaaaagcaaacacaaggtagttctctgaggcatgtgagggatgtgttagatgccttccatttgtcccactccccatgtcagatctgtactccatcctgctccacctttttctccgcccctgggtgctgacctgagcagattatataagtagaatcccttgcacattggcttctagttgaatttggtcaatggggagtcccagcagaaagctgggcagtgaggggagggaggagagaggtatgacggtgtttatttcccaggttcctcatcaggttgccttgagctggcagaggagcccattctatacaactctctccttccaggtcctgggaatctttccttcctctcatcccttggacctagggtggtgagggctcacctgcttctccccacaggtcccttcactctccatgcatcctgcctacacctttgtaagtagttccttgataaaccttcttagatgattgtaatttgagtgtgctgcccccagtggtgaccctgttgtgatggacaggaaactcttacagggacaatgagaaattcttaaaatattgtgtctgctctcaaaaaactaacaaatacttggatgcacgagcctaacactagtgggattctgtagaaatgcagcagagatttagaaaagaggttcccatgtgccagaatagctgggggaaacctcttggatggagcgggctgaggggaatagttcttgaagggagaggagaaaccactgaaaagaggccagaatactgatattgccaaataaaagggtgcacattttggatattaaataactgatgatttaagatagaaatggggagtaataagaaataatagactgtgtctagcgtatgaagatcttgagacctcatcagaggaagttgttgcatttgagacttagcataattctgtggctgtgaaaacagaaaagaaaattgcttaccagctatttaaagttaagtactttgtgacaagctggctgtgggattgactgtttactcatgttgtgggtaaacaagaagacatattgaatcttaactcagattttaaccgctggtacctgtgagtgtgaccttatttggaagtagggtctttgcccccatcattaagatgaggtcctactggatgaggatgggacctaaatcctgtcactggtgttcatataagaagaagaaaatttgaacacagacacccaggagagtgccaagtgatgaccgcgacaagggttggggtgacgtgtctagaagctgaggaacaccaaggttgcggcagacaccagaagctggaagaggccaggaccgcctctcccctaacgccttcagagaaagcacagcctggccaccaccttcatcttcgatttctggcctccagaactgagagaatgaatgtctattgtttaagctgccagtatgtggcactttgttacagtagccctagcaagctaacattcagtatgtctgaagggtagtcaagaggaagctagaaattaagatgtcggcccatgtttggagtggatttaagccaaacagcgtactatgtgtgccctgctaaaaattataataacgagaaattgttacagcctaagagtgaccccaggatttgtaactgacgttgagtgcccaagaactgcgtgataagtctattaagataaaattatttcaagtcctcactttcgtttctttacgttttctctcttttcctattagcatatacacatccagtggtcatttgaagcccgggtgcgtcaagtggtaaaagctttccctgctagcttatgctgtgggaactaactcccaaagttcagtggcttcaacaaagctcgcttctcactcatgtgttgggcaggcgtggctctgctgctcttttttctggaaactctgcagaaggcataggcagttctagtgaccaaggggaaagaagaatggcagaaccgcgtaatagctataaaaattctctctggaattcacacacattccatttgaaagtcagtctcattgccaaacctgatgtcaatgtggaagtgaatctgttcctgccacaggaagttactccaggtcatggcagagtgggcaggggtatgtcatcctcttcctgggaatacagcaggtaactgaggacagcagtatgttctacccatgttccctctcagtcacaaatgtgaatgtgtgtcccttctgcactccacatctgtgtcttttgagaagaaattgcaaaaattccactcaattatagcatcaggcccaaagtgcaggcactcatgggggcctctacagcaactctagatgtgtcttctctcagtctagtcacagatggatgcccgtcttccccgacgtgcggtggagctgggaaagatcactccattgagaacagggagaatgaatgcagcctgacccagtcactggtccagagcgctacggacatccccgtgggtggatgtgggaagggttccccacctcaactgccactaccagttaaacttcaataaattacgttgcagctacacaaaacttctgaatctcatgagtctgtgctcacaggcacaagggtgaggttcgaggagttagcttgtgaagctacttgatcactgcggggtgagaacccatgggtaaaagctttcctttctttgccccattttttgagacatttcaccaggctcctcagaaaaggccccattgatcttgcactgagtcccattgggtggccagtttggtcacacatcccaccctccctgtttcaccccctgcacctgcacccctgctccctggggtcactttcccagttaaacaatttgcacacaagcccttgctcaggccctgctctgagaggggcaattcagagaacccaagccagagccaaagcaagtcacaaggtgaagcccgcagtgaacagggcaggaactgtaatcctacaggaaagcaacccatggtggggaacaacacgcaacaagcgactgcagtggaaaagtggtgttgtggctcttgtttctttggttgggttttggttgtggctaaaggcacagttcacagtcctccgagagcatcttaagagttaggataatgccatggtttctagtacatcacagtggactttcattattcagaactgtgtcatctgcccagcaagtaattccctatagttttccagaaagcattaatatgtttaccaattgctggttctttaaagttaatgattcttcacactgtgttatctacatttgtctggggcagctaaattactcccagtaactttgcacacacaactgagcactagcttaactgacatcattaggtggcatctagaagctgtacttgttcagattctgtgaaccagcagggagacagcccagcatgggactcgtacctgcatcttctcagaaagaggcgtgtatacacagaggaacggcttcttttacaaaacagttgatttagacctaacctttgtaggtctagcatagagatggacaagtcctaggactaaaacgaaaatactaatctaggaaataacaaaattttctaagtcaggagtggccagcctgtagggtgattgaagacttctattgtttcatttatcgcctttgaagcatgtgaaaataaaactgttgtcacaaattgtattggtcatttgattaaaaacacccagcagcattaacatgccaattgaacacacttgtttacactaattaaaaaatgaatgaattaaggattcaagttttggagaagaaattgtgccccatctgcttctactggtgctttccaacaccttaattagatgggctacacttaattcctgtgggagttcctaggtcccaggtgtaggaaatacacactgaagtaagagagtcctgaaatttgggagattccctgcaaattggggctactcaccttcctgtaagcaagaccaagtgtctatcgaaggtattctctgctggcaaatgatttatggcgctggcttttgggaatccgtattcgctcaccgactcccaccccgcagagtgcaccacgtgcttgtcagttgcatggagcctgagaacaatgtaaaaaaatactcctggcaggatacctgcttagatattttcaagcttagaaaaatcattttttcacacctgtaatcctagcactttgggaggccaaggcaggtggatagtttgaggtcaggagttcgagaccagcctggccaacgtggtgaaaacctgtctctactaaaaatacaaaaattagccagttgtggtggtgagtgcctgtaatcccagctacttgggaggctgaggcacgataatcacttaaacccaagaggtggaggttgcagtgaaccgagagcatactactgcacttctagcctaggcaacagagtgactctgtcttaataagaaaaaaaaagaaagaaagaaaagaaaaattatttttaatggcaccaagcaacccaacctttttctttatttggttgttgttctgagacatttcccagaggttaggaatttatatccaaaaataatgttgacaggcatgacagtttggggttgaagagagaattgggcttgtttgcaaaatctctttaatttatctcagacatttcaccagctaattaatgaagatcccaagccaagatctagttctgtatcataacaccctgaaaagattttaacagcttctctaactctaactgcctcgtctgttgctcctgtttaacactgtgtccgtctccaagatgacgggagtcaatctcacttctttcagagactacactaaggttgagaaaggtgaggcccaaggaattcaagtgagtttctcattgtcacagttactggcagagtctgggttacgctctcctttttagacttattctaattcattctttaaaaacattgaaaggaaagagttttaatttcatatacaatagaaatagaaaagaggaaaactctctaaaagtaatatttatactacggaaaaatctaactttattttggttgaaaagagtatacagatttatattttttgtagctaatacatatttctcttttggaagtggttgaagtggaagagacaattttatgtttaatgtctcgcgtcagttttaattttctgatttaattagtttcctaattagaaggggttaaattaattaacctcattatttactatatatttaatgatttctcatctatggggagttacttaattttcaataattggaaagcttatgacaagaggggatattgccaagtcttacacttattgttttatgatcagtggcaggaataagacagattaaggggaattttaggtgagatatcagatacttgcaaaggtatttcttacttgttttgaaccatgatgcatgtaaaaacttgagttgagactccataatttctgtccaatttgaactcaatggatatgtcctttgtttaaggataaaatacatcctagaacatagacttctataagaaatagccctgtcacatgatctcagttatagacaataaaataatcatgatgcatcaaataatactaaataattataatgaaaaggagagcttctgaaactatcatctggtataaatggcataataaaatatttagtttttcctcagacttgccggtggactaaatggatgacattttgggaagaaataacagattgataagcctagcagctatatggcttgaggaaatcaataagccatgttatttcatgtttataaatacaaacaatttgtggataactatgttttcatgtagtgatgtgttttccgagagcaaaaatgaggctgcatctacaaaatggctgaatttgccttctcttcccactttagaagggcctctgcacggagatttgagcagccagaactctgcaggcagacacggacagagagaggacactgttgcccatttctccctgtctctgcattgctccttatccacagcaccactacctgggagagaccctgatccatcaagaggttatgtgagtaaagcttgggtactggtatggtttaaaacacaagcccaacgcatgtagtccagtgaagtggtctgatgataggaaatccactgtagttgaacaaacctgtactgagcacgtaggtgcattgcatataggctttgtgttgcagtcaaggcccgtccatggagtgactgagttccagcctgtaagcagcatatcaaatgccaacgtgagttgcatagagtaatggaatacaaagtgtgagatgcgacggagacagggatgttttgggaggttgtcttagaggaggggtcttgagagaccttcgaagatcaacaggaagagaaggatgcctgttccctgtggaagagaagcctgagcagaggcctgggcttgggaatgagcatggtgggctggcaggactagcagtcagctcctgcctggaggaagatgttgcgggatggagcgcgggagacatgtacaaagaagcagattggagaccttcggggaaaagctttatatgaagaaatgactgtccatatttctcataaattagaatcctactattttcaattcctatcaaaaaaatttacaggctgaagttgagacagtaaaaactggtattccatttgattccatttggaaaatatctgcccttattctgtttattttattttatttttattttattttttgttttattgagacaaggtctcaccctgtcactcagggtggagtgcagtgctgcaatcttggctcactgcaacctccgcctcccgggttcaagcaattctcctgcctcagtctcccacgtagctgagagtacagacacgtgccaccacgcctggctaatttttgtatttttagtagagacggggtctcatcatgttggccaggctggtctcaaactcctgacctcaagcgatctgccggcctcggcctcccaaagtgctgggattacaggcgtgagccaccgtgcctggcctgcccctattcagtgtataatagcaggcaaaatagtgctgctagttccacaatatccaaaaaagtactagctagacaatgctgactcaatgctctggttccaaaatgtcccatagtttcccaccacttgtagactgaagttcagtcaccttagcctgcctttcagagaactctctaagctgttgctttccaccatacaccccacctttgtacaccgtagcccgagcacactaggcccatgtcctcccactcttagcagactagactacagcacttgactctccaaacacatccagaactttcccaccgcagccatggctgtgttccatcaccagcaaccctctgcactcatgcacctgcacaaatcgcacctgctcttcctatggccaaccttagatgtcccattttatgaaacatctctgatgccttgagaaagaatttctttggtctcttctactgtgatttacataaatataaatgaattatataactggcggctctttggcttggatcaaggatgactaactcaaccacatgtgagagagttcatctcacccaacataatgtctggtgtggtgctgctgtgaaccattttcagggtaaggagtacaaacaaggctggagggagcctcaaatgtgagagcttgccttcatcccaatacttatatttaaagtatcaaaaagactgtattctaaaatactttgccattgcatcaccaccaccaccccactcccaacccctccaagactaaaacaagtttttgtttttaagacagggtcttgctctgttgcccaggctgaaagtgcagtggcgccatcacagctcactgcagcctcgacttcacagcacccaagggaccttcccacctcagtctcccaagtagatgggaccacaggtacacaccactggctactttttacattttgtgtagaaatggggtctcagaccagctacggtggctcatgcctgtaatcccagcactctgggaggctgaagctggtggatcacttgaggtcaggagtttgagaccagcttggccaacatagtgaaaccccgtctctactaaaaatacaaaaattagtcaggcacagtggcaggcgcctgtaatcccagctactccaggaggctgaggcaggagaatcgcttgaacccgggaggtgaaggttgcagtgggccgtggtggtgccactgcactccagtctgggtgacagagcaagactctgtctcaaaacaaaacaaaacaaaacaaacaaaaaaacaaaaaaactaaaagggaaatggggtccactggttgcccaagttggtctcgaactcctgagctcaagccattctcctgccttggcctcccaaagtgctaggatatcaggcgtaagccactgcacctggcctaaaacaagttttattttcccttaacacatattctcttccatatttagtatgaggcctgatgtcaaatggatgatgagtaaatatttaaggagtggatggatgcattttgaatgaattaacatcactgccagggatttttcaccttttagggcctctttaaagataatcatcagaatacaaatttaaaacttattctaataaggtttccttgttctatttcattatactttacagctggggaaacacgtttgggaaggttagatcaggggtcagcaaacatttttctgtaaaggcccagatagaaaatattttaggcattgtggtttatacaatctctcttgtgacttctcaactctgctattgcagtgtgaaagcagccacagacactctgtgtaaaaatgagcaagactgcgttccaataaaactttatgtacaaaaccaggtagcaggccagagttagcctttgggccttggtttgctgaccctgtgttaggttttccaaggtcacacactagcaagtggaagaaacaaagaaagactaaaacccaacaggtgttcactaactaatgagcctcttgacccccgtacagcactctccctgcttcactgtgataactctgcggtctcaggaggtctgtctgaatgcttgaccatcaggcaaacaagggaattagggctaattaattagtcaagactttgaaatccactgagaaatggggcctcatattaagtgcaaactatcatcctaagtaatatatttgtgacactttcattaaattttctctcaaatcttgaaaaataagtatctcctagctgccaagattttcatcttagcgtaattatgaagcctccccaaataatcattttccagttggcgatactcagtggggcacaatgccagctgtggagactggatgacgctgtttaatttgagacttattagcacagcacaggtgaaaatgaagaaagtcttagtgaaatgtgctcgtcgcatgttcaatataaaagcttattgtttagtggagctcatggaataaaagaagagcagcaatctaaaagcaggtaattcaatgtctatcaagataaatataggaattttagggacattttccacaggtattaatagaaaccatttttattaggaaaaaggcagatatttcaacgttataatcattttggggggaggggcggttcttttttttttttttttttttttttggagaccgagtatcactctgttgcccaggctggagtgcaatggcgtgatctcggctcactgcaacctccacctcccaggttcaagcgattctcgtgcctcaacatcccgagtagctgggactacaggtgcccaccaccttgcccagctaattttttgtgtttttagtagagatggggtttcaccatgttgtccaggctggtcttgaactcctgaccttaggtgatccacccgccttggcctcccaaagtgctgggattacaggtgtgagccactgtgctgggctggttttgtttttttgtgacagaatctcactctgtcacccaggctagagttcagtggcatgatcatggctcactgcagcctcaaactcccaggctcaggtgattctcccacctcagcctcccaagtagctgggactacaggtgcttgccaccatgcccagctagttttttttttttttttgagatggggtttcaccatgttgcccagctggtctgaaactctggggctcaagcaatccatccaccttggcctcccaaagtactgggattacaggcgtgagccaccatgcccagcctgttttaaccattttaatgaacaacatatacaccaaagagaaaatggtcacaaaatgaggtgtgtggctccttaaatgaattaaaatacatttttaaagtctttttacatgaataaatatttgagctttaagcttagagcaaatttagaaactgcaaatctaaaagggcgtctgtgagtcacttcttgttatgaactttctattcccagttaattctcaagacaaattttcaaagatgttataaacccaaccatatagaatttctaacactgtgctacatttcattaatagggttcacaagtaattctctccttggtggtaaattggttcattttttttttcatttaaaaacatactactccttagaaagacaaagaccatagtaagaatattatcagtcggctgggtgcggtggctcacgcctgtaatcccagcactttgggaggccgaggccggcagatcacttgaggtcaggagttcgagaccagcctggccaacatgatgaaaccccgtctctactaaaaatacaaaaattaggcgggcgtggtggcaggcgcctgtaatcccagctactccagaggctgaggcaggagaattgcttgaacccaggagatggaggttgcagtgagctgagataacgccattttactccagcctgggcgacagagttaagactccatctcaaaaaaaaaaaaaaaaaaaaaaaaaggaatattattggtcaagaatatggaggggaaaggatgaatcaaaaagaagctcacaggaaagaagcatgcaggctgggtgtggtggctcacgcctataatcccagcactttgggaggccgaggcaggtggatcacttgaggttgggagttcaagaccagcctggccaaaatggagaaactctgtctctactaaaaatacaaaattagccaggcatgcctgtaatcccagctacagggatgctgaggtaggagaatcgcttgaacccaggaggcagaggttgcagtgagccgagatcatgccattgcactccagcccgggcaacaagagtgaaactctttctcaaaaaataaataaataaataaacaaataaataataaaaaaagaagcgtgcattgattgggcagccttgactttctgctatttccactggcatataagacgccctcattggatgcctgctgagaacactggtgtatcgtcttgctcctgttactcacacgctcacatagaggacagcgtctgcaccatacctatggagggaaaggaaaataagactatgaaaagcagagacaaaaaacagttacgtttacaacgctttgtccaggcaacattccagtgattcagtgatttaatagagtcccgaataattttgatacctttctaagcgagataatttacttagtccatttacctatatgaggaagctatgtgaactttaaaagaagtattttaaaaatcaggggaataggcagatagtgttggattcagctgtaagttccattcctgcaaagatgttcagcgtattgggtatgtgttgaaggagaggaaaaatatctctccttctccctttctaagttttcagctgggctcctgtagcgaaagacagattgacaacagaaaagtatacaaattttaaaagtcttacatgacacaggggccttcataagaaaatgaagacccaaagaaatggtgaaatctgagcatttttatgctaggtttgatgaagagcaacaaaggggagaagtgagaggacaaagggtctgagctaagcacagtgagcttgacagtaagagcgctcttttccccggagtctagggagggcgcctcttccctgaggaactaatgacctccttcaggggagaagagggaaagtcagactccttcctgccatttctcaaatgcctgcagcttaaaatattcactatgtcaagctgtcctattttggggtagcaggtcctgaacaccactgtagagaaacgtcataaaaactggaactagggctgggccgggtggctcatgccttttgggagtccgaggtgggtggatcacttgaggtcaggagctcgagaccaacctgaccaacatgatgaaaccacgtctctactaaaaacacaaaaaaattagccgggcatggaggcgcgcatccatagtcccagctactcaggtggctgaggcaagagtatcatttgaacccaggaggcggaggttgcagtgagccctagatcatgccactgcactccagcctgggcaacagagtgagactctggctgctggttgcccatttttatggttatttcttgatgataagctaaacaaggggtgaattattcatggttcccctttttagaccatatagggtaacttcccgatgttgccatggcatttgtaaactgtcatggtgctaatgggagtgtagcagcgaggacgaccagaggtcactcttgtggccatcttggaatgggtaggttttagccagcttgtttattgcaacttgttttatcagcaagatctttatgacctgtgtcttgtggtgacctcctgtccatcctgtgacttagaatgtcttaaccgtctgggaatgcagcccagtaggtctcagccttattttacccagttgctattcgaaatggagttgctccgtttccaatgcttctgacactactcctatgccctgtgattaaagacagtagaaaactacaacctatgactagtcaaggtgcttgctgtgggcaaaggaaatatggactgtgtaacggaagaaagtagctataaattccaattaggggccgggctcggtggctcacatctgtaatcccagcccttcgggaggcagaggagggtggatcacttgaggtcaggtgttcgagacaagcctggccaacatgaaaccctgtatctaccaaaaatacaaaaattagccagatgtggtggtgcgtgtctgtactgccagctactcaggaggttgaggcaggagagtcgcttgaacccgagaggtggaggttgcagtaagctgagattgcgccactgcactccagcctggacaacagagtgaaaccttgtcttaaaacataaataaattaataaattccaattatgaccacatgactagttgcagaaacaaaggctgtcacagctatgagtgtttcttccttatttcgctatgaagatgtatatgtaggtatagccaatgttttcttcctttctcatcttccatccccctgcaatctaacataagatgtgtaaagtagttaacctcatatctctgtgtctggcttataggatgccaaagggggaatgtaactcaattagaagtggaagcagcagcatctaactttgaataaagggtctttgtatccagttttgggggacagaattgcttgtttttagttgtatgaaggataatggctttatgataggtggcagaagcatggttttgcgaccatctatatttggaagttaagcatggctgaaagtggtggctttgtatgccaagtcgacaaagggacgatggtgctggaattgcgttgtgtcaatttagccaagtaggagctacatttcccagagttcccttctctgcatggtttggggttagcatgggccacagagatgtctgttgaagatttggaaggcagaagtggaacagcagccattctcttttcaccttctggaggctggcacggggaccccaggcaccgccccgacacacacatgttgttgcttttctgtggctcccaggcctgggctgggcagcagctgggcccacagctcttcctgctcccgtgggatcctcctgaagcttttccacctcctgggccaggtgagtgtttaagtcctgcagcgtctgcattgagccaccccttccctgaaagcgggaggactggaggcagtgagagcctgatgagggttccagcccagactcccttggcttcctccacttcactcttatcttcccttcctgctgcccaccctgtagacttcagatgccaatcccagacagactcaacagcctcacacagatggtttaatcagccacacaaggctctgttgccaaaatacgttctcagtatatcgccttgttgccctgtttctctaattgagcttggattcagggcctgtgacacacaaattcacccacatctgcagcttccctcctgccttccctccaggtgcaatagggaaactgcacttctaactctagagctttacatcttcccccaaccgcctgtatcctcaggagcctgttactcattccttctcccttacatattccacccttcttaatagaatcacccaaaaagcttttaaataagctagtgcttttaaacatccccactttatacattccagacttcccctccactccaaatctccttcgaatttctctccctttcttcatagtcatatttctcaaaagagttgtttatatctactgtttccattttctcactaccaactcttcaacccatgctaatctgacttccactgacccactaacacagttctcaggggcacagtggccgccatattattaaattcacagacaacattggcctttgtcctactggtgtccctcagcagccaatgacactgttgaccttactgtcttttttcaaacactctccttccgtggcttcctggacaggacactctcctggctgtctctctggctatacctcctctgtcatctttgcagatatttcatcccctatgcagctcagcaagggctcagttcttattttgcattctctccaaaactctctactatgctgcggtatcagttaccacctgtttgtatccccttaaatttcatatgttgaaatcttttttttttttttgagacagattgtctctctattgcccaggctggagtgcagtggtgcaatctcggctcactgcaacctccgcctcttgggttcaagcgactctcctgcctcagcctcctgagtagctgggactacaggcatgcaccacaacacctggctagtttttttgtatttttggtggagatgtggtttcaccatattggccaggctggtctcaaactcctgaccttgtgatccactggccttggcctcccaaggtgctgggattacaggtgtgaggcaccgcgcctggcccatatgttgaaatcttaactccacaaagtgatggtagtagaaggtagggcctttggaagatgaccaagtcatgaaggtggagcccttctgaatgaaattgtgcccttctaaaagacacaagagagctctcttgccctgtttctccacgtgagggtagagtgagaagctggccctctgtgaatcaggaagcagccctcaccagctgccaaatctgctggcacctcgatcttggacttcccagcctctggaactgtgagaaataaacgtttactgtttaagccacccagtctatggaatttttgtgatagcagcccaaatggactaagacaccaaccctacacaggcaactctcaaaggtacatatccagctcaaacacttttctgagctatagtcctattccacttgctatttaacatctcctcttgctcaaaagcactgcaaactcaatatgccccaaactgaacttaatttctatgctaaagcttgttattttctagtattttttgtatctgcgacaggagccctccatccagttacacaggccagaaacttagaccttggcacctccacctctcccaccctccctggcctatatatagtctgttcctaatgattttaccctaaatatctcttgggtggtctacaacccatctctgcctgtccatgtgctcgtactccaaactctcatcatcattgtgagcctggactatgacagtgacctcccagccattccacctggctaggtgaagtaagctcactcttaccttccaatacattttccacacagagccacaccacattttttttcttttttttcttcttctttttttttttagactgagtttcactcttgtcacccaggctggagtgcaatggcgtaatctcagctcactgcaacctctgcctctcaagttcaaacaattctcctgcctcagcctcccgagtagctgggactacaagtgtgcaccactacgctcggctaatttgtttgtatttttagtagagacggggtttcaccatgttggtcaggctggtatcgacctcctgacctcaagtgatctgcctgcctcggccttctaaagtgtggggattacagacgtgagccactgtgcccggcccaccagaccatatttttaaaatacagatctgatcatgttgcccctgctttaaagtatttcagtgatgtcctctattctgtggcccaaaggctatgagtgaaccagtccttacagactgcaccagccacgtctcctacccactgtctctgttattttgtcactctagtcgtattacactccttgtcattccaaatacctcctgtgctgcttcccattccagaacatgctttctcacgtccccagatgctcttccctcctcttttcacatgactagttaattccagtcgtctttcagaatgggcgcggtggctcatgcctataatcccagcactttgggaggccgagtcaggtggatcccctgaggtcaggagttcgagaccagcctggccaacatggcgaaaccccgtctctgctaagaatacaaaaattagccaggtgtggtggcacacacctgtaatatcagctacttgggaggctgaggcaggagaatcacttgaacccaggagacggaggttgcagtgagccaagatcacacctctgaactccagcctgggtaacagagtgagactccatcttaaaaaaaaaaaaaaaaaaaaaaggaattatgcacaagcacttgctgaaggaaacttttctcagtttagttaaatcccctgagctctcttagctcctctgctacagcacctaccacccctctcatgttttaacagagacaggattccactatgttgcccaggctagtcttgaactcctggactcaagagatccccccatcttggcctctcaaagtgctgggattacaggtgtgagccaccacacctgacccattctcatttatttatttgtgtgatgatttaattaatgtgtgttcacctggctaaatctacatgccatgaaaacagagaggatgccttaatatttttgtgataatgtatcctccagctcctgcctcagagtctggtatgtggtagatgcttgtatgtcagttctatatcaataaagcacatgctggctaacttattccaaaagggagtttgagaaatattggatatctcactaaatggatgggttcccagaaacatttgggaaccagggcagctcttgataaggaggtgtcaggaactagtcagtcaaatcctccaagggctacagtcccacaccaaccatttagtaagtgcaggaatcaaagtgggggaacacagggtctagttgagccatgttcctggatggaggattgcaggcaccttaattgagagtcccaccagtgcttcacacaatgggcatggagtgggcattgagatatttcccccagaggaaactggggagcccggttaagaaggaggaagggatgttgacaaccaaaacaatgaatgttgagtgggccttttactctactatttcctaaatgctttaatgccttggctctttccatcttcccttctctctagcatgcatttctcctgctcttcatgagagcatttctaccatcatgcaaatatcctccaatatctgccatctttttcttttttttttttttttttttttgagatagagtcttgctctgttgcccaggctggagtgcagtagcgtgatcttggctcatcacaacctccaccttctggtttcaagagtttctcctgcctcagcctcccaagtagctgggactacaggtgcgtgccaccatgcctggctaatttttgtatttttagtagacggggttttgctgtgttggccaggctggtctcaaactcctgacctcaagtgatccactggcttcagccactgaaagtgctgggattacaggcatgagccaccacgcccagccagtgtctgccatctttaaaaacaactgcaaccccttcttcctgctttagaggatatgtaaatgtttgagtctttgatcccagctctttccatgactgcctctttctcattcattcatgattgaatgtcacctttcaggcagcttcctaaacatgttatttaagcatcacctttccacccacttcatttggtaaactaatgaatgaatgagaaagcacacctgtgtccttcctctgatcagtgtcccattgtgtggttttctttgcctaccagatgcacctcttttcttatgttgttcaggcatactgtgtttcacacactaaacctcctgcttcatattagagtttgttagaagtgtattgaaacattaatatgatgtaggtttggggtaaaaaatggaaaataaatgaatactggagaagtatccaactctctatgagagtaactcctcatgaggagttactgttaaatcaatttgtctgtgatcttactttggaatatatgaaatggaacaaattgttgttaaagcagtttgaacttagatggcttggcttgtacacatttgtagtttttctcttttgctgaatcctaggcctgttttataagttaggtttcagtttcagtactctgcagataacaaaacttccagccttgcaagttatcaagctgatctgcaagttaagtaaatgccagccagcacaaaactcagtactctaaatacagaaacaaagtttagcctggcatggtggctcatgcctgtaatcccagtactttgagaggccaaggcaagaggatcgcttgaggtcacaagctcaagaccagtctgggcaaaatggcaagaccccatctctacaaaaacattacaaaattaccaggcatggtggtgcatgcttgtagtcctagccacttgggaggctgaggcagaaggatcgcttgagcccaggagttcaaggctacagtgagctatgatcacaccactgcactgcagcctgggtgacagagcaagaccctgtcttttttttttttttttaaattcttaatttttgttggtacagacacactgtcttaaaaaaaaacctcacaaaatccagatatttggagatatgacatttataatgcccagcatccaataaaaattactaggcctgtgaagaagcagaaaattgtaatgcataaccagaaggaaaatcaatcctttgaaacagatatgtaaatcagacaaattatgaaattcacagataagcatttaaaaatgtctattcaatgacttttaaaaaaacatacatataatgaagaaagaaatggaaactactaaaaaatgatttttggggctgggcgtggtggctcatgcctgtaatcccagtactttgggaggccgaggagggcagatcacttgaggtcaggagtttgagaccagcctggccaacacggtgaaaccctgtctctactaaaaaacagaaaaaaattagctggatgtgatggtgcatgcctgtaatcacagctactcaggaggctgaggcagaagaatcttgaacctgggaggcggaggttgcagtgagccaagattgcatcactgcactccagcctgggcaacagagcaagactccatctgaaaaaaaaaaattgtagttttttgggcaactgatttgtactttattgagatttcttaatttaaaaaaaattaatatttaatttttgtgggtacatagtaagtttatatctttatgcagtacatgaagtattttgatacaagcgtacaatgcataataatcacaccaggttaaatgaagtatccgtcacctcaagcatttatccttcctttgtgttgcaaacaatccaataatactctttgagttatttttaaatggacaataaatcattgtttcctatagtcaccctgttttgctatcaaatattagatcttattccttctatctatattttagtacccattaaccatccctcgccccctcattctactctctatctttgtatgttcaattgttttaatttctagctcccctaaataagtgagaacatgccaagtttctctttctgtgcctgacttatttcacttaacataaggacctccagttccatccatggtgttgaaaatgacaggatctcattcttttttatggctgaatagtacttcaccatgtatatgtaccacattttctttatccatttgtttgttgatggacatttaggttccaaatcttggctattgtgaataacgctgcagtaaacatgggagtgcagatatctcttcaatatactgatttcttttcttttggatgtgtacctagcagtgggattgctggatcatatggtagctctatagttttctgaggaactccaaactgttctccataatggctgtactaatttacattcccaccaatagtgtacgaggattcctctttctccgtattcttgccagcattctttatttcctgtctttgggataaaagccattttaactggggtgagatgatatctcattgttttgatttgcatttctctgataatcagtaatgttgagcaccttttcatatacctgcttaccatttgtatgccttcttttgagaaatgtctatttagatcttttgcccatttttcaataagattattagattttttcctattgagttctttgagctccttatatattctggctattaattccttgtcagatggatagtttgcagatattttcttccattctgtggatcgtcactctattttgtttattgtttcctttgttgcgcagaagctcttaaaattgatgtcatctgatttatatatttttgcttttgttgcctgtgtttacagagtattactcaagtaatctttgcccagtccagtgtcctgaagagtttccccaatgttttcttttagtagttttatagtttgaggtcttagatttaagtctttaatccatttcgacttgatttttaaaaataagatgaaaaataaaggtctagttttattcttctgcatatagatactgagtttcttagcactatttattgaagagactgtcctttgctcaatgtatgttcttggcaccttgttgagaatgagttcattgtagatatatggatttgtttctgggttctctattctgttccacaggtctatgtgcctgtttttatgccagcaccatactgctttggttaccatagctttgtagtataatttgaattcaggtaatgtgattcctccagttttgttctttttactcaggatagctttggctattctgggtcttttttggctccacataaatttaggattttcttttccatttctgtgaacaatgtcattgataatttgatagggattgcattgaatctgtagattgctttaggtagtatggacattttaacaatatgaattcttcaaatccatgaatatggaatatctttccatttttttgtgtgtcctcttcaatttctttcatcaacatttgatagttttcattatagagatctttcacttccttggttaattcctaggtattttattttatttgtagctattataaatgggattactttcttgatttctttttcagattgtttgctgttggcatatataaatgccactgattttcttttctttttttttcaattttagttttttaatttttttttaattttttaattttttttagtatttattgatcattcttgggtgtttctcagagagggggatttggcagggtcatagctgaaaaacaatgatcatcagaaccttagttcctgtcaggcaaaatcaagaagcctcacatacatatagttggagtcccagaaagagagaaaaatatttgaagaaatgatggttattttccatatctgatgtctaatgtgaacccactagaagccaagcacaccccaagaagaataaaccaaagaagataactcagataactccaaggcacatagtcatccaatagcgcgagccacaaactgggaggaaatatttgtgattcatgtatctgacaaaggacttgtagtgagaaaatatgaagaactcctaaactcaacaataagaggacaacaaactgaaagctataaaagtggacaaaagattagaacacatattttacaagagaagacatgtaagcacctcaataaacacatggaaacttgtctaacatctttattcattagggaaatgcaaattgaagttataagatgctacagcgtgtccaacaaaatagctaatattaagataacaccaaatgtggcaaagtgtggatcaactggaactctcatgcattgctggagtcattggaaaatagtgcaaccactttggaaagagatctgagtttcttacgaagctatatatttaccatatgacccatcaattccatttctatgtatattttcccaaaataaataaaaacacatgcccacaaaatcacttgtacatgaatgttcatggtctgtttagtcctaatagttgcaaaattaaaacagcatgaaatccaccaacagatgaatgataaacatgttgtggtatatccatacaatggaaggactgcaaactgtatgacttcgcttatgtgaagttttggaataggcaaaaaaatgaatctgtagttataggaataagataagcaattgcctgagttcagggccactttttggggtgatagaaatattctatatcacaattggtgtggctgttaatggatgatgacacttgtctgaacttatcaaactagacacttaaaagtagtacattttgccgtatttcagttatatctttaaaaagttctttttctttttttttttttttgagaagtagtttcactcttgtcacccaggctggagtgcactgacgtgatattggctcactgcaatctctgcctcctgggttcaagtgattctcctgcctcagcctcctgagtagctgggactacagatgcctgcctccacaccaggctaagttttgtatttttagtagagacggggtttcactggccaggctggtctgaaactcctgacctcaggtgatttgcccgcctcggcctcccaaagtgctgggattacaggcatgaaccactgtgactggccgataaagttgatttttaaaaatgataaaagattcagttttgactgtgaacaagttacctcaaaaacaaggctattgtttttctaatctctatatgcagtttctactaataaatgtttctaatgttttaagaaataacagatatgatttggatttctttgaaagagattgagcaggggagtaatgtgatctggtttgtatttgtttaatagattttattttttagagcagttttaggttcacagcaaaatggagacgaaggtatgaaggtatcacatatacctcctacccccacaaatgcagtctcccccgttctcaacatcccccaacagaatggtccatttgttacaaccactgaacctacattgacacatcattatcccctgaagtttatagcttttattagggtgcacttctggtgttgtacattttatgggtttggacacatgtataatcacatgtctgatttgcattttcaaatggtctattttaatgatgaataaatgtgatgtggtttctagaaaagaaaaaaagggggatggatttttgcccagacacctggatgtttggcttttcttgaacaactgggacatctgaggacgttgttgtatggtggtcatctggagctgagcagttgccacccctctagatggagccagcactctctccagctcacaacggtcaacactcacctgcttccctctttatgttacttgatgataccctgtgaccattacccgtgatgagttcaggtatagggcgatagcgtttttttttttttttttttttgagacaaagcttcattcttgtctcccaggctggagagcaatggcgggatctcagctcactgcacccctgcctcccgggttcaagcgattctcctgcctcagcctcccgagtagctgagattacaggcgcacgccacaatgcctggctaattcttgtatttttagtagagatgcggtttcaccatattggccaggctggtcatgaactcctgacctcaggtgatccacctgcctcagcctcccaaagtgctcggattataggtgtgagtcaccacgcctggccccgattgtgtcttaaacaccttcccagagttccctaggccttggggcagctagatgttaggcatgcacccaagggtaatagggaagatgcaaaggaaaaagcactgtgtatgacacctgtaatcccagcattttgggaggccaaggcaggaagattgcttgagcccaggagttcaagaccagcctgggcaacatagtgagaccctatctctacaaaaaataaaaaattagccaggtgtggtggtgcacacctgtagtcccagctacttgggaggctgaggcagaattgcttgagcccaggaggtcaagcctgcagggagttgtgatcctgctactgcattcctgccagggtgacaaagcgagaccttgtcaaaaaaaaaaaaaaaaaaaaaaaaaagccagattctaagtggatttgggcaggaaaagagcataatgcaatagttaactattcaagcttacagtaaaaaaacagcagggaacaattgctaagataacttccttcccaactcccaccctgccacccaccattaaaggtaagacatggtgtaaggggcacaaaacctaaatgactgttcttaagtttctgccataccactgatgagagaaaaaagcatttttaaaacagcttcatttcttaaacacctgcatttgtagatgagattcctgcctgctacactgctatttctgaaatcacattgatgtcagccactaattccacctaaacatagagcttaggctgggtggaaaagtgaaattgtaccttttctgccaactaatagtcatcagagtatgtttcagtttacataaatttttccataccttgggattgtaacttgactttccaatcttctcatttggtgctattcctacttgttaatattggagacttgtactgtatctatatgcaaaggctagaatttaaaaatcatgcaactgcccagtgggttcatcctgtccactgcctagataaagccaatttatcaagacaggggaattgcaatcgagaaaaagtttaatacacgtagagctgtttaaaatgcagactgggccagccaccctccctgtccgggagggaggtggggggcagcccccgcccggccagcctccccgtccgggagggaggtggggggtgcctctgcccggccgccccttctgggaagtgaggagcccctctgcccggccgccaccccgtctgggaggtgtacccaacagctcatttagaatgggccacgatgacgatggcagttttgtcgaatagaaaagggggaaatgtggggaaaagatagagaaatcagattgttgctgtgtctgtgtagaaagaagtagacataggagactccattttgttctgtactaagaaaaattcttctgccttgggatgctgttgatctatgaccttacccccaacccggtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggtaggccgcagggtcctctgcctaggaaaaccagagacctttgttcacttgtttatctgctgaccttccctccactattgtcctatgaccctgccaaatccccctatgcgagaatcacccaagaatgatcaataaaaaataaaaataaataaaaataaaataaaataaaataaaatgaagactggggttttattattactcagatcagcctccctgaaaatctagatgctagggtttttcaaggatagtttggtgggcagggggctggggttaggggcaatgctgattgtttggggttgcaatcctagaggtgtggaaaatggccgttctgtgccggctgcttctgggtggggtccacagagaagtcgctggaccgggtgggaccatctggtcttcagaaatgcaaaagcttgaaaagatatctcaaaaggcaaatcttaggttctacagtagtgacgttatttacaggagtagttggagaagttacaaatcttgtgacctctggaacaatggctggtaattggttaattatgtctacatcttagcagaattcaggcccctctcacactgctaacctggtggcttttcattagttttacaaaggtggtttagttttgggaatggctattagcatttaaaccataactcaatttctcccaaagctagcttggcctaagctcaggaatgaccaagggcagtttggaggttaaaggcaagatggagttggttagatcagatctttttcactgtcataattttctcactgttacgaattttgcagaggcagtttaaatttcttcttcttcttcttcttcttcttcttcttcttcttcttcttcttcttcttcttcttcttcttcttcttcctcttcctcttcttcttcttcctcttcctcttcttcttatttttgagatggagtcttgctctgttccccaggctggagtgcaatggtgggatcttggctcactgaaacctccgcctctcggattcaaccgattcttctgcctcagcctcctgagtagctgggattataggtgcgcactaccacgccggctaatttttgtattttttgtagagatggggtttcaccatgttggccaggctggtctcaaactcctgacctcaggtgatctgcccgccttgggctcccaaagtgctgggattacagacataagccaacgcatctggccttcaatttcttgacactgataatgtttcttaatcaattgtctgcttgttttcaggtgatggctttgtaatccctactttggattttttaaaccaatgttttattaaagcttaatgagttctacaagatgtacaataaagatcagcaatctaccctatctgaaagacaatctgtaaaaaacaaaacaaaacagaaaacaacaacaacaaaaaaccccaaaaagctccagtaattatttattttggcatttacttgtaaataccaaaattcataccagtgagaatattataacagtaaaaaacatctgatttaaccaactccatcttgcttttttttttttttttttttttgagatggagtctcgctctgccaccaggctggaatgcagtggcacgatcttggctcactgcaacctccgcctcccaggttcaagtgattctcctgcctcagcctcccaagtagctgggattacaggcgccttccaccacgcccagctaatttttgtatttttagtagagatggggtttcactatattggccatgttggccaggctggtctcaaactcctgacttcaggttatctgcctgcctcaacctcacgaagtgctggaattatgggcgtgagccatcatgccaggccatatatatatttacccagctcctattcaagatggagttgctctgattcaaacgtctctgacaccaccttggcctctcaaagtgctcggattacaggcatgagccaccacatccagcctacttgtatatttttaaatagaatgcttatgctgttgtttctcaatttttcacttttattattgactcctaactatggaaaatgaagacagattatacctccctcactccaccccccattcacttctcaatatagctatataataaatattcagtgttttattattaaagctgtgtaaagattattattcatagctgggtcacaatatatactgggattatattccaatccacttctcttttttttttttgagatggagtttccctcttgtcacccaggctggagtgcaatggcgtgatcttggctcactgcaacctccgcctcccaggttcaagtaattctcctgcctcagccttccaagtagctgggattacaggtgcctgccaccttgcccagctaatttttgtatatatttgatagaaatggggtttcaccatgttgaccaggccggtctcgaactcctgacctcaggtgatccactcgcctcggccttccaaagtgttgggattaaaggtgtgagccaccacacactgcctccatttcttatataacattattttccctggatttaatttgcttccctgactttgtcttttgtgcagctttcctgtgaacatatccagtgctgtatcagggccatcttttttgagacctctctcctagagcctggagcttttgctccaatctggacttgctgccttctaggcctgatgtgcacctgccattttggaatctcccttcaccatctttctttttcctgaactaacttactttctctctctctctctctctctctctctctctctctctctctctctctctttctgtctctctctcaggctggagtgcagtggtgtgatcatagctcactgcagccttgaactcctgggctcaagccattctcccacctctgcttcccaaatatctgcaactacaggcacatgtcaccacacctagctaattaacaaaaatctgttttgtagaaacggggtctcactatgttgaccaggctggtctttaactcttggcctcaaataatcctcccgcctcaacctctaatagtgctagaattacaggtgtgagccaatgtgcccgtccctgcatttgttttctaattttgtccttattccactttcttagagaattttttaaaacttttcttctactgaatttcctttaaaattttatcatggaaatttccagacatatacaaaagtagagaaaataacataattaaaatctttagcaccaggtacccatcatccagcttcagcaatgatcaacccatggccaatcccagacttcaaatcttcatctgtaaatccttcagcatgcacctgccaaagataaagactctaaaaaacccagaataccattttcatgcctaaagctatttgcaacaattcctattctgttgcactttcacttcctctgtttaagagaaaattttaagtgttcgctttctccccgtgtgttttccttttttttttttttttgagatggagtctcactctgccacccaggctggaatgcaatggtgctatctctgctagctgcagcctccacttcccgggttcaagtgattctcctgccccagcctcccgagtagctgggactacaggcatgcaccatgcctggctaatttttgtatttttagtagagatggggtttcaccatgttggccaggctggtttcgaactcctgacctcaggtgatccttccacttcggcctcccaaagtgttgggattacaggtgtgagccaatgtacccagcttttttccttttgtaaaatggcatgttattcttgtttgtatggatacaatattttcttttatttgtaaaaatcaaaatagagttttcattaacttttctttttcctgcatcatttttcttgttaatcagttgtattttcctgtttgtgctcctctcttaggggctggagattttgtccaggtagctgatgatccttggctgcccgcccgtatttcaccatggagcactcaaatgccatttggagtctctgtgctcatgaatgaggctcctgaaagcgaaggctcctctgactctcagtgtcttaaggtgcttcctacaagcacagatttggacagatttctcccaaaagaatctttttatctcttgcctggctacaaaactgaggaacacatggaacaaggaggccttgcagatgctttggtactctcctgcccattacttcagtttccaggatgtccccatcccaatcaggagtccttctgggtcacattcttcaggaagtaaactggtcagggagtagcttgactgtacaaggtgtgtgtgggggggaggggagggttcttaacattatgctgtatgtcctagtgcactaatttttttttttttgagatagggtctcactttgttgtccagtctcgatggcagtggcaggatcatggctcactgcagcctcaacctcgcaggctcaagcaattcttccacttcagcctcccaagtagctgggactacaggtgcacaccaccacacccagccaatttatgtatttttttgtttcaagacagggtctggctctgttgcacaggctggagtgtagtagcacaatctcagctcactgcatccttcacctcctgggctcaagcaattctcccatctcagcctctcgacttgctggaactacaggcatgcatgaccatgcccagactatgtgttttttatagagatggggttttgccatgttgcccaggctgttcttgaacttctgggctcaagcaatctgcccacctcagcctcccaagttctgggattacaggcgtgagccaccacacctggccactagtgcattgattaacacaagacagagatatacaagcaaaagaattagcatggaagcaattacattgtcattaacttcagataacatggttgtttatgcagaaaactaagaggaatctatgacctaccagaactagtaaggaaatttagcaatttcactggatagaggatcgtaataaattaactgtattttataccagcagtaaataattcaaaaattgaatttaaaaagggaaactattaaatatgtgaacacatacctgtagaaagatctctaaacatatgcactatactatgcttatgttggaaaacaatactgtaaagatgtaaattgttctcaaactaatcttaagattcaatgcattcccaatacaaacttcagaagatgtttttttgttgggggtgagatgacagttgaccggttaacagtaaattcacatgaaaatgcaaagggttaaaaatagctatgacaatcttgaagaaaaagaagtttggaggactaatgctcttaaacaatgagacatattataaagctatagttactaagacagtgtggtattgtcaaaaggatagaaaacagccagtgcaacaggagagagattccagaaacagctttctatgcaggtcacttaacctgtgatgaaggagacactgctgcctgttgggttacatgctgttcatggtcttttcataagtggcacaagatcaattaaatattccatataccaaaattaactccaggaggtctctagatcttaacattaaaaggtaaagtaataaagtgactagcagatcagaatctatcttcatgatatcagaacaggcaaagatttcttaaacaagtcataagaaacagtaactgtaggctgggcgtggtggctcacacctgtaaccccagtactttgggaggcaaaggtgagtggatcatgaggtcaggagatggagaccatcctgactaacatggtgaaaccctgtctctactaaaaatacaaaaattagctgggtatggtggtgtgcccccgtagacccagctacttgggaggctgaggcaggagaatcacttgaacctgggaagtagaggttgcagtgagccgagatcgcaccactgccctccaccatggcaacagagcaagactccatctcaaaaaaaaaaaaaaaagaaaaagaaaaaagaaacagttactgtaaagaaaaaggtagacaacttggattacattaaaatgaggaacttgtacttagaaaaagagattattaaaagaatgaaaagacaagctacacagtaggataatatatttacaatacatataactgaatccagaatatacaaagaacacttacaaataaaaagaaaaagacagcaaatggaaaaggacttgaacaggcacttcacaaatgaagatattcagatttgaaataagcaaaggaaaacatgttcaatctcatcaggtatcaagaagatacaatgagagacacaatattatttcctccacctgaatgattaatattaaaaaaatcatactacctagtgttaatgaggatgtgggggaactggaactcttgtgccccactggggttgttgtaaacagaatgtccctgaagcccagtgtaaccataccctatgacccagcaattccaccccagccatatgcccgacagaactctctacacatgtccacaaaaggacttatgcacaaattttcttaaagcattattcttagtagacacaaactggaaataattcaaatgtccacaagccacagaatggataaatagtattcatttgtgacacagaatattacataatgatgaaaatgaacaaacaacttctatgtggagaagcatccatgaatctcactaacataacattaaatgaagaagccagacacaaaactcagctctgctgttggacgtcaggattgtgattacttctgggggtatagtgactgggagggggcattatggtggtttctggagtgatggtaatgtgatattttctgttctgggtggtgttacctggaggagggggcattatggtggtttctggagtgatggtaatatgatattttctgttctgggtgtgttacctggaggtattcacttatgatgtatgcttttccttatatatgttgaatttcacttttaaaatttcattaataaaaacatgagtgtgcattattcaaggctttgctggtgacattaaactgtgtgactctccaagggatgtggaactgctttattttactatctaaataaaataggcaggctccagaacctgttgtttgatctaactaacagccttgacatcagccaaggagctcacgctggggattctgaagcggaacagtcagcgttcagaccaacagccatggcatggattcaggggcccactggggcctaatttgaggcagattctgtacaaaactccacttaacacctgattactgatatagctcagctctgactagtgaaccactgttggctcctgcggtccccagaaatcagtgtcagctcagaagcagcatcccagaaccctcctaactttgtggctagttcccctgcccttatacaaagttactcaaccaatatccacagtttcctttggaggaaatttaagagaacgagtcataattctcttgcattattaaaacagagagtctttttaagtgtacctaactgctcctttatttaaatacttcttggttggcaaattcaataatttctgggaactaagcgattggtcatgactcctaggatagctcataacaggtctctattgatcagaaataaatgttgtggctgttatacaaatcaaggaagaccatatggatgggctgatgtggtcggctgttcctggttccccgcactcagtgtcccttcctatggaatcattgtatgtccccaccctatagacctctgactttctttggccagtgaaaaatgtagcctcctgactttctttggccaatgaaaaatgagagaagttgacacatgtcactgctggggaggccccataagagccagtgcaggggctgccatgctgtccttcctgcctgtgtgattgttgaagtatgtgtgaagatggaacccctgttagcctggatccctgagtgactacctggagcagctaatgatggaaatggaatgtgtgtcagaagaggttgtaagccacgatgatttcaagctgttgctgcaatgtaatctagccacaaaatgcaaaactggagatgcaagcatgaaaataaacaagaaaaaagccagctctcaataggtaaggaaaactaaccagggcggatcctgccagcatccaagcataacagtgagataaatctgacacagctgactccgtcttgctccttacctcacaagctaactgctttttctcattcccgcatgtaggctgagctaactatgagaggagtttagtttatagtttgaagcaagaatgataacaggctatattagtccattttcatactgctatgaagaaatacccaagactgggcaatttataaagaaaaagaggtttaatggactcacagttccacatgtctggggaggcctcacaatcagggtggaaggtggaggaggagcaaaggcacgtcttgatgttgtcaggcaagagagcgtgtgcaggagaactgccctttataaaaccatagtatctcatgagacttattcactgtcacgagaacagcatgtgaaagaccctccccatgattcaattacctcccacgacatgtggggatcatgggagatacaattcaagatgagatttgggtggggacacagccaaaccataatatagtcccttcccaaaactaacccctgaggagataaggaggctatacatacaaatagcaatgttctgttaaaaatgtataggagtgtattagagcaggtagtaaggcagtcacgagcagggcagaagaggcccccacacccaagaatgtcaggcaaccattaggtgatggtcatttggttaagctgtctctctttaaaatggtaattggtagcagctgccaacagggagagacggtcttcaatagatagaaaacacctggagctggtgatcagcagcttccctaaagaatctcaggagttggaggagcaggctcaagcatgtgaactgaggcaaaatggcggagcttaaccagtatatgaccttcctctaggaaatctcaactggtaagggaagaatgccccaagcgagcatgtgcatgactttagtaaacacactgcacatgcggcccctcccaagtgctggcagaccactgtgcatgcagacagcccaccccaagggaagaatcgcgggagaagagacacaaacctcagaaccacaccagtgtataaaaacccaaatcaagggctgaacagggcacttggatctctcaagtcacccacttggccctcttccaagtgtactttactttctttcattcctgccctataatttttttaataaacgttcattcctgctctaaaacttgctttggtctctccctctgccttaaacatacttctgcctcttggccgctttcctccaaggaggcaaggattgagtttgctgcagacctgtatggattcgctgctggtaaggtgcattgtgacctgaccaaagacaaattttgcaactctcttgggctcctgctgacacccaggtgtgtgtggtcaccagtcatctcctgacctcaacctcctacttgttccctcttccccaatataaaaagaagcttgagattcctgcctgttaagatggttctttaggaccttcatctgccatcttctcagcttgctccctctccaacataaagtcccttcccttgcccccagcaccttgtctcttgacttgctgtcatgcagggcatggtatgagctttggactcaactacacaagcagtacttgagagactggcctaaataaaatacagcatttcttccatactcaaactttcaagattcaaagtcaccggaaagagcatctaatttgtcaaacttaatggtttgaaacaacaactgcaatatgtctgtgtgtgtgtatcttttacacctttctctctgcttacacagatatgtaaaacataaagattttggctcccttttacttacaaaaatatacaactaattccccagttaatacaatgatgaagtccagaatattccacctaaaaatatgactgtaggagaccagaatgtgccaccccaaacatgcctattatgcatacagattatatggagctgatcattttgagtagcagcagtcccaggagaaactggaaagcagaatagaagtgacggttttgtaagagatatttgggccgggtgcagtggctcacgcctgtaatccccgcactttgggaggccaaggcaggtggatcacaaggtcaggagttcaagaccagcctggccaagatggtgaaacccagtctctaacaaaaatgcaaaaattaggccaggagcagtggctcatgtctgtaatcccagcactttgggaggctgaggtgggcggatcacgaggtcaggagatcgagaccatcctggctaacacggtgaaaccctgtctctactaaaaatacaaaaatttagctgggcatggtggcgggcacctttagtcccagctactcaggaggctgaggcaggagaatggcgtgagcccgggaggcggagtttgcagtgagctgagattgcgccactgcactccagtctgggcaacagagcaaggctccatctcagaaaaaaaaaaaaaaaaaaaagagatgtttgtgtctgcaaaggaaacttccagttgtaagagtgtcttcctcactgcgctaggaagagaaggatgactaaatcaccagggacttttttattaattgaaaaggcaccactttaaataagcagaacaaacctatcccttgtttaaggtgccttttctagccagagtgctttaactgggcttcccttctgtccactgcaactttctttttttgtttcagagaacaaaaaaagggtatttaaatcttaagtcaatgccccttctttgagatctatagatgctccttgacatatatatgatggtgttacctcccagtaaacccatcgtaaactgaaaatatcataagtccaaaatgcatctaatgcacctaacctaccaacatcatagctcagcctctcctaccttaaacctgctcagaacacttgcatcagcctacagctggacaaaagcatctaacacaaagcctatttacactaaagtgttggatatactttgtgatttattgaaagtaaaaaacagaatgatttcacagcattgacagcatcatgaggtcagaaattttttttttttttttttttttgagatggagtctcgctctgtcccccaggctggagagcaatggcacgatctcagctcactgcaaacttcgcctcccgggttcaactgattctcctgcttcagcttcccgagtagctgggattataggcacccaccactacacccagctaatttttgtattattagtagagacagggtttcaccatattggacaggctgctctcaaactcctgacctcaggtgatccacctgcctcggccttccaaagtgctgggattataggcgtgagccaccgcacctggccaaggtcagaaaattttcagtcaaaccatcataagttgaggaccatcagtagaggtttactaatttctttgggtatttcccatgtgtataggagggatatatattattaaacttctgtttgtttttcttttgttaatctgtgttgtgttacgtggagtctcagctaagaatgcatgaagggtgaaagagaaaattatttttcttcccatataatatcatggcatgtcaccaaatcaatatggatatatttaaatttaaaaataattataggctgggtgtggtggctcacacctgtaatcccagcactttgggaggccaaggtgggtggatcatttgaggtcaggagtttgagaccagcctggccaacatggtgaaaccccacctctactaaaaatacaaaaattagctggggatggtggcacgtgcctgtagtcccagctactcgagaggctgaggcatgagaatggcttgaacccaggaggtggaggtcgcagtgagccaagatggtgccattgcactccagcctgggtgacagagcaagactctgtctcaaaataaacaaaagaaaaaaaaataattattgcaaattccacaacatggctttgccatacttcattgaaccagaacgtgaacgctcaccaacagggctgattaggttttgccaccacaaacaccgcgataaacatttttttttgcactgcaataagaactggtgcttttatttctataagatagaattcctgttattcctgtcttctttcctatttctctcttctggagtggaaaagtctgtcctatgcctgtcccaccatggaattttggaagcacgtaacttgtttgatttttcagattcgcagctggagaggaattttacctcaatatgaattctaccttgagactaccacattttttttctttttcttttttttttttttttttgaggtggagtctcactctgtcgcccaggctggtgggcagtggcatgatcttggcttaccgcaagctccgcctcctgggttcacaccattctcttgcctcggcctcccgagtagctgggactacaggtgcccaccaccacgcacggctaattttttttttttttttgtatttttagtacagacggggtttcaccgtgttagccaggatggtcgcaatctcctgacctcatgatccacccgtctcagcctcccaaagtgctgggattacaggcgtgagccactgcgcccggctagactaccgtattttatttaggtgataattagatgagactttggactttaaaccttaaagttgatgctggaaatcaatgtattttgcatgtgagaacaacatgaattttggggtgctatgggcagaatggtatggtctgagtctttgtgtctccccaaaattcatatgttgccatcctaacccccaaggtgatggtactggggggtagttagatcatgacagtggagcccataggaatgggattaatgcccttggaagagaggctccagagatctctactgccacgtaatgacagagcaacaaggcatcagctataaataaggaaacaggttctcaccagacactgaatgttctggcaccttaatctcgagcttcacagccttcagaactgtaagaaataaatttctgtctttataagccactttgtctatggtatgttactatagcaacccaaatggactgagaaacatacatacgtacatatgcaagtgtgtgtgagagtgagagaaaggtagggtagcaaaatgtttgcaataggtgagttatgacattcacattctcattttattatttcaatgtttcgagaagcttgaaaatttttcttttttatttctttttcattttttttttttgtttgagatggagtttcactcttgttgcccaggctggagtaccatggcgtgatctcggctcactgcaacctccgccctccccgggttcaagtgattctcctgcctcagcctccctggtagctggggttacaggcacatgcccccacacctggctaatttttgtatttttagtagagatggggtttcaccatgttgaccaggctggtctcgaactcctggcctcaggtgatctgcctgccttggcctcccaaattattctcatatttttaaataagtggtttcaaaataatcatgaatccctcatttggctaaaggtaattattgctggagggggtcatgaatctgaatgagaccactttaaactggacaatactgagctgcatttattgctgaagtttttattgaagtataatatataaagcagaacataatgataaggcatggtatataataaagtgcacaaatcattaagtgtacagctcaaagaattttcacagggagaatgtacccgtgtaaccagcaggaaatagaacctcacctgcctccttttctggtcactgtttccccaacaggataaaaaatgttatcctgtcctgatttctgatactttagggtcattttcctgttattgaattaatacaaatggaatcacataataggttgtatttcgtgtctggcatcctctgatcaaaatgatgtctgtgcgatccatccatattgctgccaggtgtggcctctctgtccacactgctataacacagccttccatggagtaaaggcagctcggtggtttatctatgttgctactgatgggcacttaggcagttttcagttttttcttattacaaatatgtgattctaaatagttccatatatgccatttggtgaatggatgtatacatttctgtaggatatagatccagcagtggaattgctgggttgtaggatatgcacacctctggttctgacagatgctgccagttttccaaagtggttgtactgcttcacaccgccatgggggttctattgccagtcttttccattttagccattctggcagataaatagtgagattgcactgtaattttgatttgcatctccttgattcatggggttgagggctttgccgtatatttatgcgtgcgtcacatatgaagtgtttactgtattttcgctcattttaaaaagtatattttttttctaataacttcctggcatggagacaggggcctgtctttccttgattaacctgactttctccctgggggttctggtctagcaactgctgctgaagttttcagtccctgtcaccttctgggtgtcacatttctgagggattcaggaagcattttcacctgaatcttttattcccctaaaattttctctacctggcatcagagcctctatttcatttttgtatctggttcaaatgtctttgccttgatccatagtattttctcctttttacaattgattccagtgtagaactagcagggaaaacatcaagcacttggaatttaaagtttgagatgtcatattctacatagtaatgccattgctttcattttttttttttctgagacggagtcttgccctgtcccccaggctggagtgcagtggtgcaatctgggctcactgcaacctccacctcctgggttcaagtgagtctcctgcctcagcctcccgagaagctgggattgcaggttcatgccaccacacccagctaatttttttatttttttgtatttttagtagagacagggtttcacggtgttagccaggatggtctcaatctcctgacttcatgatctacccgccttgtcctcccaaagtgctgggattacaggaatgagccaccgcacccggccctgctttcatttatatagattgatttttctgggtgaagcacaccaaattctataaaagaactatggaaacctcaaatacttttccagtaaaaaatgcatttttgaaatgataatacataatcatttcaaatacatgagaaatacagtatcatgagaaatacattagttctgatgactctggagacattgaatctaaatactccacaattcaatttctcaagcattttatgtatatttgcatggagtacacacacacacacacacacacacacacacacacacacacgatggtaccaccaagcccctacactagccctaggtctcctgtccccaggcttcttgttatgtgagattatcttgttttggagtcactgctcacccgctattcttgcagccaacagcattcgtggttaaaaatgactgcaaaataatacatagagcagcagatggttgatgcatacatacattcagagcatatacagcactcacttagttatgccattacattatttttctgagtgactgagcttaaccttggagaaatctcataattctcaggggtggaatatgaggccttgacccattctcatggtttcactccatttttattcagatgagcattagtcactgcttcatgggcctcaaagaatgtactttgcttcctcctggaagatctagataaaagggacagttaggggcaaaaatcagaaagttactattgtcctaatacttgtgatgaatgagaggatgggagtcttgcaggacagtgaaaagatgggataagctcaaatgagacaaaaggttagaaagttagatacagacgcaatgtctttctttggctcaagagtcagaattcagttatttattgatgaaggggcgatgatgttcctatttgggatgaggatgagaaatgaaaatgaacatgtaaaagtcatcagaggaaggcatgatttaggtgttgagaaatactctgctaggtagaagtcttagctatcctcttgcctatgtgggggctaaatgttggtggggcgacactatgtatggtagccatggcccaagtcagtgtttcttttcttccttagtttaattagtctttcaaaccaattccaaagagcaaccacaagttgggcctgcacttggcgggtgtagcatatgctggtttttgctgcctgaggaggctgttcttgccttctggttatggctaggtcttcaggtcttcagatagctcttcccaagttggtgatggccactcaaagttgtcacacacagtcagcatcagggctgtggttcccgccagtgagcctggctgggggaagcttggtgatagtgaggtcaaccatgttcatggcactgacgatggaagagacccaagagattattttggaaaatggttttcaattagcttaagaacaagatcttatgtagaactcctatatagacagacaaaaactaaaatgctcttgttgctggcgagagtgctcgcttgaagcctgttctgctcagaatctccacatctggacactagggaccctcagaaaacaatctgaaacatacttttggagtccaactttgctgtgtagagatggttaaacttggggcctcttggataaggagccaactcgcccaaagcagtgctcctggctccaacattttccacgcctggctgcctaatgtctggtatggaagtgcaccagtgaagcctaggttgagagttgaactgggacaccaaggcagcaaaggatgccaggaatgtcaggtgagaattaaacggacattctcatgggaaagccaaggtgtgagcctgggaaggaacatttactagacagagactgcggttagggcaaaagtgaagtcttgagtctggggaagatttaaaatgaagcagttgagaaacagtccaggcagtcagcatcagggaagtcttgtgagtctggatgactgcttttaatatctgtggtgttagaagctcaacctgtagaagagcctacaggttgtgctgtcagggatcagggtgccttaaagaactaggcagatatcacccccttgcatgtgtgatatgagcatgcagatggccagctccttagcatatgattggggtcttagcatgaatggactccatgaaacccacccccactattggaaaatgtggctaaagtgtagacatcactaatcattggcgagtcatattatgtattcctttaaagaagagttttggccgggcgcagtggctcatgcctgtaatcccagcaccttgggagggccaggcgggcagatcacaaggtcaggaggtcgagaccatcctggctaacacggtgaaaccccgtcactactaaaaatacaaaaaattagctgggtgtggtggcgagcgcctgtagtcccagctactcaggagcctgaggcaggaggatggcgggaacccgggaggcagagcttgcagtgagctgagatcatgccactgcactccagcctgggcaacagagcgagactctgtctcaaaacaaaaaaaaaaaaaaaaaaaaaaacagaagttttgcattgaggaaaatcacagcaccttgagaacaaagcaatatcaacctcattagaaggaacaggggagcagagttcattgtgcttttgtcagtttcttaggacactatgatgagattttgctccattcaggccatgatgcctattcctgtccacaggagcatttgatccttacccccacgctgcgactccgaggcagggcggacacaattgtcccgttttataagtgagaggagagcatttagcagtggtcacagagctaatctgtcaggatcaggactggaatccaggctgcagggttgatgctccgtccacgcgtcagtgctgacttcctgaggaatcagcaccgtggctacaatgcggagagcagaagtagacaagtcatccaggcaggggttggaaaactcagctcatagttgcgtcctctcagttgagtggagatgactcatgacattaatacggcaatcctctaaccattccctacagagcttggcctcttaaagagtaacgtgtgctttggagttaagctgtgctcatctagagctcttattgaaccatgattaatcactctttccacattcacaacctacgggatctgaacttgacccatttttaaagccattcaccctgcctggactccatgcatattttcactgcaccagtctgctgcttttcctcccacccatcactatcatgtcacgccatccgtcagttgcctccctctagctgccagtccccattccccaccaacatgctacttcttcttcttcttttgtttttttgtttgtttgtttgttttcggtttttgttttttttgaggcagggtctcactctgtcgtccaggctagagtgcagtgcagtgctgctatcacggctcactgcagcctcggcctccccggggctcaggggatcctcccacctcagcctcttgagtggctgagactacaggtgcacaccacaatgcccggctaatttctgtattttttatagagatggggttttgccatgttgcccaggctggtctcaaacttctgcactgaaatgatctgcccatctcagcctcccaaagtactgggattacaggcataagccactgcgccaggcactacttccaacctgagaagtgagttgagcaactgttggaaatctggcccaaggagacttggagtaagagtccaaagagtcagctttcttcctgatcccggcgatgtttctggtgtcaccccttctgaataagtcacttgctgagttactatttactggacacacccgtctcagaaaatacaggtcactccaaagcactctgtggcttacatttgtaattgtggattttgctttgaaacttcaagggtataaagatatttgattcactctgatttccaactttgattttaagttctggggtacatgtgcaggatgtgcaggttagttacataggtaaacgtgtgccatggtggtttgctacacagatcatccaatcacctgggtattaagcccagtatccattagctcttcttcctcatactctccctcctcccacgccctaccctctgacaggctccagtgtgagttgttccccccatgggtctgtgtgttctcattactcagaatcggtgatgtgtcttggtagtactgagtctagtcttaggacaatgctgtcttctgggctgtggaaggagagaattttgcccagattcgtggtcatgtcacatggagctttgtccccatcaggactgtttctgttcactttcccaggggcacagcgtgtgtgttatatatgcctgaaccttgttcaagggagaagatgataagaattaatgagaacaagtctccatggactacatgaccctgttcatttgaatcttttatctaaaaagttttcatgtgttgacaccaaatatattaaagtatattttaattaaaaaatgtttttgaaggaagagatatggaaaagagaattactaagtaaagaacagaatgggtcctagatataatcacaatatctgcgcttagaagaaccagaggctttctgtccactggagcccagggccaaatgtcacttcctaatgtctgtagtctttcacaaaccagcaacttttccaaaaattaagagaacaaatatgaaaataggttatgagtcttgcccctgagtatgtgtcatctgaagggaaccatatgtgatggtgatgagtatgtgaaattgtgttatgccagtcgatttagttttatgtgtgtttgaaattttccaaaatagataagtaaaaaaaaaaaatcagaaatgcattgttaacagaaacatccttgaaaagttttttttttttttttttttttttttttgagatagggtcctgctctgttacccaggctggagtgcagcggtgtgatcttggctcaccacaacctctgcctcccagggtcaattgatcctcccacctctgcctgctgagtagctgggtctacagacacgcatcaccatgcctagttaatttttgtgtgtgtatattttttgtagatacaaggtttcagcacattgcctaggctagttttgaactcctgggctcaagcattccactggtctccgcccaaagtgtgagattacaagtgtgagccactgcacccagcccatccttggaatagttggaagctgttgtatgtatgatagagaggatgaaagaaaaacgacacattgaattgggctcctgctttgaatggaaataatggggtcccagagaggaaacaactgtcagagacatggttgacaagatttatgtaataggctctagggaaagagaaaatcaaagcattttgatctcagggtcccaggaggtagcttgtcaattatggaaccttaggaatagaatgtatgggcaatcgaataaggcgttaactttaataataataataaaaacgtttctgggtctggtgggcagaaattagactcaagttaccacagctgagtttttgtttttgatggagttttgcccttctcgcccaggctggagtgcaatggcatgatctcgactcagtgcaacctctacctcccccattcaagagattctcctgcctcagcctcccaagtagctgggactacaggagcacgccaccatgcctggctaatttttgtatttttgatagagacggggtttcaccatgttggccaggctggtctcaaactcctgatctcaggtgatccacccacctcagcctcccaaagtgctgggattacaggcgtgagccactgtgcccagcctacagctgagtttcaaagcccctcactggacctgctcccagtcctggggcctcttgattgaagagaaggctgggcccctttggggaaattccccacaacgtggccatacctgcaaactacacacctcccttcaaatgtctgcagggagacccctggccccttaccagtgtgcaagggaaatgcacacccctgtaggacattttaggcactggctgtggggaagttcccgttctctggggtccggttctgacctcagctgcggctcagcaggacagtttcatgcaccccacagcatggcattccgcactctctccaccctcctgcctcagggcttgcttcgcaaccatgaggactgaggacttagcctgcactcagaagcctcccagaagcagggtggtgaggctgacgccttgggagcaaacatcaaccaatggggtgtaggagtcagcgggtgagtgttgtggcctcttgcccttcagggatagactttagggggagtacaccctgcttgtccacagtggacaccagctgtccagtgtcttttttttttttttttttttttttttttgagatggagtctcactctgtcacccaggctggagtgcagtgacatgatcttggctcactgcaacctccacctcccaggttcaagtgattctcctgcatcagcctcccaagtagctgagactataggcacctgccaccacacctagctaatttttgtatgtttagtagagacagggtttcactatgttgaccaggctggtctcgaactcctgaccttgtgatccacccgcctcggcctcccaaagtgctgggattacaagcatgagccactgcacttggccttctccagtgtctttttattggctcctccttcctcacacccactctctctgcttccctgctcctgctttcagagatcacctcccaaacaaactacttatacccaatgttctgtctcataatttgcttggggcagggtgactcaattaagaaactgtatctgcactaacgtggatctctggggcctcctcctaccaccatgtctaccagtcagagtggggattatggaggttggaatcttggcccaagtccatcctgctacaggcccagtgagcacacggactcaaatcgtggctgctcccgtcccgttactgactgcttagaataaagatgcttaatcagctgcagaatatccacatcagctcactcatctgcgaagtaaaaattggtgtggaaaagaagggccaagtaaaatccttgaaactgctccctgtagcacccctgtaatcccgagggaattatggagattagaatgcaaggggtcagttcctgaggaatcactatttaaattatctgcttggctggcatcagagatgagtgtcttgggtaatcaatgtggattatggtgattgcagctgtggtcccagatgccatatttctggtggagtaaataaacataaaccctggaacctggtatgcagtaatcaagttgacaaaaacaaacaaacaaacaaacagaaacaacccactttgaccttcattttcttatgtcacgattttgtcaattcttctgccctccatattatatcgtcttgaaggaacttgacatcccaaataataccagatggtcgttatattgataacgtgattctaactgcacccgctgaggaggaattagcaaatacaacagaaatcccaataaaatatatgcctgctagaagacgggacataagccccaagagatgtttctggaaggacatctagtagcatggggtatattagaatatcccctctaaagtgaaaggataccaccttgaagaaagtggtacaatgctcgtcctggaatcggggctacatttctctagcccattttccagataactgttgcaccgggctcctattaatttcaataggaatggcaccaagttcaagaggccaaagatgagacccagagccagcaaatgagagttgcggttactgaggggaacttacatacagggtggcccatggttgcaggcagggaggagaactgctgccgcccacagaaagcatgcagtttacaggacattttcacaacaccctctgtgaaccccccaatggctgagatggtctcagttaacttagaaagttctttttgccaaggttgagtatgcctgcccgtgacacagcctcaggaggtcctgatgacatgtgcccaaggtggccagggcacagcttggttttatatattttaggaagatgtgagacatcaatcaatatatgtaagaagtacaatggttctgtccagaaaggtggggacaactcgaagcagggagggggcttccgggtcacaggtaggtgggagacaaatggttgcattcttttgagtttctgataagccattccaaaggagggcaatcagatatgcatctatctcagtgagcagagggatgactttggatagaatgggaggcaggtttgccctgagaagttcccagcttgacttttccctttagcttagtgatttttgggccccaagattttcctttcacatctccacctggaaaccttcatttaacccaaaacaagggggcctgaacccctgagttgcctgagttctgtgggacaggtcaggcgctcagatattcctcatagccaaggaacgaatctccagattgtcctcgctcaccactctgaatacacattcaggtgcatctgccatacggggtcattcttaggatctgcttaagttactttattgctatcaggtgcatcaaccctaagtaactaataaggctgccagtattaagggaaggagagagtaacagagagctcttcagtaagtccaaattgcagtgaaagtaacctaactaatcattgcaaatagggtggatcgatcagaagccagaatcatcaaggtggcatgcacagaagcattcaattattaaacagaaatagcatgggagactgggcactgagcacatcagaatgctcagcaattgctatgggcagatggcccaggcccccctgctgcctgcttctatcactcacagcctctccctccactcacacccgttgcctcatggcgtttccactattgatcagttaatagaaaaaaaggtgcagcctcttcactgcggagtctgtggcatgtgttggcacctgctggcagaggaccattgctgccttaaggccccaattaggtgtgattctgaaacacaggaatcaatgaccatcttcccatgggacaaaatttccagaagtaaatctctttgctggctttgcctgaaagaaaaggtaggctgaggcatggacccacaatagcttcaggggcctgattgcatgagcaggtagcccaaaccccctcgttgcccaccacagttccaccagagccactgccccagttcctactacagccttgttggagctcccatatgatcagtgaaggaggaggagaaacctgagcttggctgatgattcacttggctcattatatgggtgcaaatgcatgacagctgtgttacagccacattcagggatgcccttgaaagactgcagatagaggaacttttcccaatggttgaagttatttaagcagggcatctggcgtattgtaagacctaaaagttcaaatgctgccttgacacctttgggcctccatggctccaaggtctaaacttctaggtcctcttctctcccaagatactcacaatctccacccccttgtgggatagactcctacccaggtagttctcccatcaggtgggtgggctgcatcccacctggccctcaacctaatgggttccaccttccagcaaactgttggaattactcaaacaggctgttcacattctcctgtaatgagccaccacaataccctctttatcaactcgcccaccccctgtcactacaaagcctgcttccccctcccccgaccagtgcactctgctcccaagtgcggcctcactcccacggtcctcctccctgggctgagtctatgtgactgagaaactgccattgatcatacctgtccagggccaggtgtcacgtgttctgccatcttatactgttttgggcagggtatcccttcctcatcaatggggtgaagtagaggcaaccaaagaacctagtaatccacggcttgtggcctgatgtgagggtgtggattggtggtctctggtcacggggctggaaggaaaaggactccgcttcctggtcctcattgtacatagcaacaggcaggtgctgctggctggggcaggtatgattcccaagggtccagacccctcaggaactgaggctcaatggacaccatcaggtaacctgctaaggtgagagctgagggtgaggggaatttagaaagctttaatgacactgggtgatcctgggcccactaatcctcaacatgtgtgggcattctgcttttgattgtattcagccacttaaggagatggctgtgggtctctctgggaaaggactaggggaattgtgatggcatatactagacatgatattgcagggtccttcctgctagaacccagcctcctctttagtcagtgggttcttgatctggaaattggtctcagtctgtaagggattgtgtcttttaggtttctttgatttgggttgaagtcaaagcagcaccctggctgctgacctgcttattttggccttgggggtaccatactctcttagtcctcccccatatcccaggagtcaagcacccttgggcacacctcgttggcattatggtcactgtgagcttctagcttctggtgaccaagtgtttctgcctggcccctgtcacttgacacaacatcgtctgcatggatatttgcgtgtgatccgcctcttaccatcattcctggcctccgaggagatctaccactgagcttttcactagttcattcttgatggcctcagtgaagggggcttcctctgggccccccaggaacataatcctctgaatcttccagccttacataatctatctgtcccagaagcccacttccctcagccttttattccttcctctcccatctgccaaggcagctcaggatttccacaactaattacccatcactttccccaggctgctgatagccacactggtggtgagtgccccacctcatggtgtccttgctggttctgtgtcctgagagagtgcccccaaatctacaagttcttccttatttaggattatttattttattttatttttccacaggttattggggtgcaggtggtgtttggttacataagtaagttctttagtagtgatttgtgagattttggtgcaccaattgcccaggcaatatacgctgcatcctatttgtagtcttttatcccttaccgcatcccactgttccctccaagtccccaaagtccattgtatcattcttacgcctctgcatcctggtagcttagctcccacatattagtgagaacatacgatgtttggttttccattcctgagttacctcacttaaagtaatggtctccaggccaggagtggtggctcatgcctgcaatcccagcactttgggaggctgagatgggaggatcacctgagattaggagttcgaaaccagcctggccaaaatggtgaaaccgtgtctctactaaaaatacaaaaattagccgggcgtggtggcaggtgcctgtaatcccagctatttgggaggctgaggcaggagaatcgcttgaacctgggaagcggagggtgcagtgagccgagatcacaccattgcactcccacctgggcaacaggagcaaaactccctctcaaacaaacaaagaaacaaacaaccaaaaaaaaaaaaaaaaaaagaatagtctccaatctcatccaagtcgctgagaatgccattaattcattcctttttatgggtgagtagtattttatcaggtatatatacaccactgtttctttatccactcgttgattgatgggcatttgggttggttccacaattttgcacttgtgaattgtgctgccataaacatgtcctgagagagtgctcccaaatctaaaagttcttccttattcagttttatatctgctccagcagatgacatttgtcaatctccctcaaaatctagtccctggggccctcccctcattcttgctggaatcttgtagacattccttgcaaacccttcagttatagacattttccaccttatgaggcctagccaggtaatgctacaacttaaccctgggttctttcctgaagccaggagaaggggagggaggagggcctgagggagtggctgctgcctgggggtggagtggggtagaggcacctgccacagcttccagactggagaaagagctagggaaggggtgggggcgacttctgcaagctctgggcttcagggtgtcctcaaggaccggcgttcttttctttgcaagaaagagctgtatgtaaaaatgtatttctctgtatggctttccctcaacagtatactcagccatttgagtattggggccatcctccaaaaagccagatggttctagtaactgaagacagatttgacctcacaaaatgccaaactcgttcttgctttcaccccactgccaaagaggaggaaatgcctattataaaagcagctttctgaaacacgcctggtaaactgtggatgcagcttactggcctggttaaaaagaggcaggagaaaaagggccttggttattccccagccctctccccacgtgtttctgttttctttcactttaattcagatacctgaggaatgctaggggcaaaagcaaaccaagaataactgtggtttgtgcactcagtctatgtgtaaaagatacttggctattaacaagaaatgttacacatcccactgttagacacttcccaagataataatttaatgttatgaatatgactctttgaagattcatgtttagcctcttacatcgtgggacatttctaagttgagacaaataagaaagtagagacaaataatttctattctagaataagatacttcaagtaatcttatctcaataatttactcactttaggctagtgagtaactttatccaataaataggtacagtcatgtgtcacttaacaatagagatatgttctgagaaatgcactgttatgtgattttgttgttgtgcaaacatcatagagtttatttatacaaatctgtatgggataacctactacaccttaggctgcatgggatagcctattgctcctatgccatgaagctatacaatgttactacttacatcagcattacagctgagtaacatgttgtgctattatgactcattaggtgataggaatttttttagctccatcatgatcttatgggactatcattgtgtatgtggtctgttgttgactgaaacgttattttgtggcacatgcattttgattttcttcttcagaagatgagctctcctaggctacatattttgtgttcgtctaagcatttggacttgctgaatactgcaataggtgttcattgtgtttacaattgagacctcaaccgatccttcaggggctttgagcaggagttgcctatcagaactgtcccagattggcaagggagctgggactctgtatccctgcatcagtctgtcattggcttcaggtcacctgctgggatgagacaacactgagacaacatcggcaaggctgttttatgcagcagagctcaattcccaatgagggacatagctataagccatcaacagctgatactcagaatctagggaaggaagaatcggtgcagagggagggacctggacaaattaccatagcatccactgcagtccactccttatacctccaagcccacttgcttctcacagtgagttctttccatccagggttctggttgttgggacaaggcacgaccctcactgttgcagctggtctcaagtctgtgacagatactcatcatctcccttctccactagctgcctgtgttttcttgcacctgtgctagcatctctgttgaccttgatgtcagaatcatccatgaggtaaggccctcatcccggagggatctgacccactggttaccaagatcttttcatgccatgattgccacatctatgtatttacattctggagaataacatgtccatgctaatcactttgctgccaaacacatctgacacggtttggctgtgtctctacccaaatctcatcttgaattgtagctcccataatccccacatgttgtggaagggagccagtgggaagtgattggatcatgggggaggtttctcccatgctgttcctgtgacagtgagtgagtctcgcaagatttgatggttttataagcatctggcattttccctgctggcacttctctctcctgccgccttgtgatgaaggttgtgtttgctttcccttctgccatgattatgcatttcctgaggcctctgcaggcatgtggaactgtgaatcaattaagcctattttctttataaattaccagtttaggtatttcttcatagcaacgtgagaatggactaatgcagtatccttctctgctccctccgtagccacaacctgccacctcctcataatcagttacccctatcacgttgctgactcttgtccttgcctgctagtctcttggcatgagcagcccaaagtgaacaagttacattgaactattgctatggcacctgatgggagctctgtctctctaggaaccagaacctctagactcacagagcctaaagtcgcatggacaagaaggacaacgttgccaggtggtcactgatgtgacaggaagcatgacgatgtgcttctatttcatgatttccaggcctgtccgtatagtctaccttaaggacagccccataaaaagacattgattgatggtatcgctatctatagagggatggtgttgcagagtagagtctcctagtagtatctccctagcacatttgagaggccatcccccctctccatcaggctggcagtttctgggtaaaatagtgtcttaatttcctagggtggctgttaacaatgtgccacaaactgtggggcttaaaacaacagaaatcaattttcccacagtgtggaagctacaaatctgaaatcaaggtgtcagcagatagggctatgctccctgagggctccagggaagagtccttccttgcctctcttgttcctggtgttgctggcaatcctcagtgttcgttggcgtgtggtggcatcactcggctctgtcttcacatggccttttctctctgtgtctgtgtcttcacacatccctctcttatgaggtcactgtcattggatttagggcccacattaatccagtgcaattttaacttgattacattagccaagaccctatttccaaagaaggtcacattcacggataccaggggtgaggacttcaacacttcttttttctcaatcggggagaagtgcagctcgacttgcaacaagtggtctgtgatgggacccgaggccatgtgctcattgctgtaaagtggggccattggttcacaaggatgctaaatgcaatcctgtatcagaggatggaaacttacaaaggtccttggacagtgacctggctgagaccctgcaggcaggagaggcaaatccatccctgctgatgaatagccgctcttcaaggtggctggtgatccccttccagtgctctatgctgcagtgtatgctttctggaggatgttaaaagtgataaaaacatatccacactttgtccttattccctgtggttcatctacaagcctctttcacagacatccttccttccagtcattcaccttccagacctttagccactgttcatgagtctgtatcatcttctttcaggctgctcccctttccaaacaaaatggaagatcaagtgcagcacctagagctctgccccttggaagggtctcccctgactgctgtctcccaaggccacccagagtagacatgagacagcagcagtcttcttgctgacttgcaccaacacatcaggctgacccacctgtgaattccccttggccctgctggtgccgcatcagctggacatgtggccagggctttgagctgaggggtaggtgcttgtacagtgatgacagacagcagggtggtctgggccacctcttgtggagctggcttgcaccctccagctctgctctgcaccacttctgttttatgctgttttgctgctgagcccacccaatcttgtaggtgggtctgcaaaattccacatcttgatggttatattttgttccagtgtcacttaatgtctcatgctcagatgctctatttctgccagagccctggctcacacaaactgcttttccaacagtgtaatgtttcctgttgtagacggagtgactttcctccagaaccctcagggtctatactgtgactcttttactggtgtttatcataaaatcctcatggagttttttcccattacaggtactcctagtaacataagctttgcaaatcataaagcccaagcagttgggctgctttcactgcagccaggacttctgctagagccatttcctgctcttagccccaaccgaacctggcagcctttccacatcaccaggatgtgaatcagagcagctgcctctggcattcaaagtgctgaccaagtattaggtttcctttccagcgggggaggtaccagatgcaatacgtatatttttataatgaaaggaataccctgttacactccaggccactgaagccctaacatcatcaatgacgttgttggggtccgattcttcaaagacaaaattatttctcacatcttggagcacacgtattttacagaggactctaacaaacttgagacttcttttcttgcttgtcttgtcttattgacatcccacatcaacacagtggagcagcgtgatgttctgatgacagcagttttcaaacactgtggtctcaggaccccttcatattctttaaaattgagtaccccaaagagcttttgtttacatgggttatatatattaatatttactggaaaataaactagagacattttcaacatatttgtgtatttgtttattaaaaataaaataaacccattacatgtctatataagtgatacctcattatgaaaaataattatttttcataaaatatttctgaatagcattaacatttttgcaaatctcttcaagacagctagaacatcatatgtttctacattccatctgttgggatatgttattttagtttaagattgtgaagaacatccactttcatacagatatacagcagacaatagagtactttaatactattttcagataattatggatattttttctgtgatgctatattaaaactcaatgagtggtagcaccttaaagatttgttgtgatgtggaatctgaaattgtatcatgcatgtttattatgctgttacattaaaattcgttggtcttggccgggtgtggtggcttaggcctgtaattccaacaatttgggaggctgatggggatggatcaattgaggtcaggagttcgagaccagcctggacaacatggtaaaatccccatctctactacaaatacaaaaaacttagctgggaatcgcttgaacccggaagatggaagttgcagtgagccaagattgtgccactgcactccagcctggatgacagagtgagactctgtctcaaaaaacagaagcaaaaacaaaccaaaaaatcagctcctacttgaatgaaatagattcataccttcccattatagaaaaatctaaaataagtatttttctataagccagtgacatgacttgattacaaaccgtaagtaacctcaatagacaactgagtctgcactcgaatgattgctagatggctgcaaactaccttttggaaaggttttagtagatgtcccatgatttgtttatatgtctataattccctcttctccagtatagcacctcgttcagttatgtggttgtatcttttgctagtatcttttgtcggatggtatattagcttgctagggctgccataacaaaataccacagactgagtggctcatactagaaatttattttttcctagttctggcagctggaaatccaatcttgatatcttctaatcttccaatactggtatcttctaatgtctctctccttggcttgtagatggccaccttcttgctttattctcacgtggtctatcctatgcacacacacatccttggtgtctctttgcatgtctaaatttcctcttttcataaggatgtcagtcagattgaatgaggccctatcctatggcctcattttaacttaatcatccctttaaagatcttatttctaaatatagtcacactatgaggttctaggggttaggacttccatatataaatctggcagggggtaagggaggggggaaggagagacacagtttaacccataagaggtgacaacccaggaaggtatatttcccaatactgccatttcagaggtaccatatggcagacgggagttttataccttttcagattcttttccttttcagtgtttttcaagataaaattggggctatgctttaagatgaagctgaaatattatgattttttatttgtgtatttttaagagataagccagactttctgaacagggtttgtcccttctggaaatgctccattggatctctcctttgtgggaatattctattcagtccctaaatttatgacactctatttttcacaaattatcctcagtcatccttggctttgtccttattaactattctgctgctcacttagctatcaatacagacagctgtggcctggggaatcagtagggaatataatcacaagcccataatgcctttcaagattcatagagatccattgaggcccgcctgtgggcaacacagttcatccattcctccagataacaggccctgagactagatgcagaactttttccaaagaagaggattcatagtttacatctcattcccattagttccatgacctcaagaaggtgatttgccttaaagaagcacaagcttgcttccagattggggccatgcacagttgctctgcatgcaggcagtcaccatcagctgtttttaagtggtgtttgaaacagccctgtgaataatccggtatttaatgatgttgtcccgtcctctaggttccagtggaggactttctcttttctcagtgcattctcctgatacttgttttactctgcaagaaacaaaatcttatatgaaaacatgttgctaatctttaaatagttaaaactttctgactaaatttacttgtaaatgcacaggatttcacgacactcattttatatacttaaaaacaaagcttattaacaccttacttttttcctgccatttctgtccatcatttttaaaatttcaacttcttttatattgctatatcatgtgcctctttatgaggtgctttcaatcataatttctggttagaagcttctgatattttctcagtttctgtggatgtgtttgtggttgttttgtgtgcatgtgtgaggggagagttaaattacctctttcttttgagtgagatggagctcttataataacttgtatcccaatttttccttctcaggaagcaaatttagtagggaccactggagactacccatctgccttatgactctgaggagataaagcattcttcagccattcctgttggagccaggtgaagcattctagctccaacacctcaaccatctctaggaacagcagcaactgctatctcgcctctcctcctttaaggaaaacaacccttaagggaagcaactgagagctgggtaagaagaaagcaatcacgtgctaaaatcttccggagaacaaaagttagtgaaactatcttagacccctaattcagaactcttgcaggaagagtaaatacttatggaaagctgagaaagcagtgtctagggcctccagtccacccctagagggacgtgtgggggtggctaggggaacgttttgaggaaagttcattggtcaacttgttcaacgtggcaaactcatttcaggcaagagaggcagcaccgtggacagcgccaaccctcctgctcccgggcggggcgaggtggcagcaccgcggacagcaccacatgtggtggcgcacactgggagccgccaggcgcggggagcgcagcagcaccgcggacagccccaaagccgcgcgctctgagccaggaggcggggagagatggccttatcagctgatggcttacgtagggctagatctccacttggataaggcaggtctcggtgggcgcgccagcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttccttagcctctgagggcttcagacctgccgcgcttgcagccacaccatctccaacggatgctcactagcaggaaattggggccaaattcacaggcactttccagaaactcccccactggccagaggttgcaaacatccggattggctctgggcacagtggccgccttaagtcctcctgaacaccccttctgcaagtaccccagggcggtctcctgacccagagatggatttacctgtgaacctaacctccttttccctctccaccccctcccctttggagaccaaccacagcctcggcaaagacgacctgcgccccagctcgcccctgctctcggtcttcggagtgcttattctcaccttgctgggctttctggtggcggcgacgttcgcctggaacctgctggtgctggcgaccatcctccgtgtacgcaccttccaccgcgtgccccacaacctggtggcatccatggccgtctcggatgtcctggtggccgcgctggtcatgccgctgagcctggtgcacgagctgtccgggcgccgctggcagctaggtcggaggctgtgccagctttggatcgcgtgcgacgtgctttgctgcacggccagcatctggaacgtgacggccatagccctggaccgctactggtccatcacgcgccacatggaatacacgctccgcacccgcaagtgcgtctccaacgtcatgatcgcgctcacctgggcactctccgctgtcatctctctggccccgctgctttttggctggggagagacgtactctgagggcagcgaggagtgccaggtaagccgcgagccttcctacgccgtgttctccaccgtaggcgccttctacctgccgctctgtgtggtgctcttcgtgtactggaagatctacaaggctgccaagttccgcgtgggctccaggaagaccaatagcgtctcacccatatccgaagctgtggaggtgggtatctcagcaatccttaaaaatactcgacttgcatctgtacaggctatatccccaggccacctgccccacccccacacttgtagaaaatggaactttttgtgtttgggagtggggggagtaaactgggagagtggaagaaagcatcagagatgtactttgctctgacatgttccctctcacagggctaatcatatcatgttccttctctaatgggttgtttgttaaatatacagaacacgaggagttcagactgcgtcattctgcagggtcccctttggcccccaaattctatggatctataacaccctttagaacatctgaataagctggtatctggggtacgctgattcagtacactggaaaaaactagcagcttccagcacttagaatgggggtgttccaggaggaggggaggcagggatgggagcatgatttgataagaagactgccatgagtcaggtgatgcaggttagcatttcatcctagtctattctttttctttgcaaattacagcagccggtttattaaaaatatggtatcacctaggttactgtcattctgtggcatcctcccgtcctgacgtaagactgaagatgttgactgcactagtcccggagcctgcatttgttatctgcttccactgccttagggtgttactttatgggtctatcccccacagccctattaggttgtaggtgtgactgaggaccacttgtctgccttcctgaacatgagtaaagctgcggaaggaaattaaaaatccaggaaagagaattccctagctctctatgagaggtatttactgcatgacaaccactatagcaacagcgagggagcttttctcatcttctcccactcctgtttttttgttaactcttaataatctgaccctacgactcatgattctgcaggctgctcccccttcattaccaaggaagattccttgaatctaattcacacatttaggttagaccagaagtctacacagtccccattttctgttgttggctctgaaacaagaaagtagtttaaggaagcatatggagtgcatactatgggtttggtgcaagaggtaagcgaatgatagagatgttgtctttgcccatgaagagtgtggtctagggagggaaatagacatccaccctgagctctgtatatgctttctagagtcagtagctaactctaaccatccccagtcagtcaaacttagagggaccagaggtgtagctagggaaaaaggggagagggcatcatcctagaggaaagaagaaaacgaggggtcagaggctacctgttcttttacctatatcagcatttctcagcgaagggtaatactgccctccaggaaacatttgggctgtctggagacattttggatgattaagaattgagggccaggtgcggtggctcacgcctgtaatcccagcactttgggaggccgaggcgggcagatcacaaggtcaggagatcgagaccattctggctaacatggtgaaaccccgtctctactaaatatacaaaaaaattagccaggcgtggtggcaggcgcctgtagtcccagctactcgggaggctgaggcaggagaacggagtgaacccgggaggcggagctggcagctagccgagattgcgccactgcactccagcctgggcgacagagtgagactctgtctcaagaaaaaaaaaaaaaagaattgaggatggggtgttaatggcatgtagtatagagaggtcagaaatgctgctaaatattgcacaatgcacaggacagcccctcaacagagaattgttcagaccaaaatgtcaatcgtactgaatttgggtaactctgatctattagatttctaagctgaacaaagagtgctgatgggtaagaacactgaagcttccatcaaactacctgaagtgaggttccatgtgtatgagggtccactcaaattccagaccaggaacaagaagactggtcacctccaagggccctccttttatgaatcttcctctcccctgatgtttattcaggcaaatataatttacagtcagccctaaacacagctttagaaggagaaagttaattacaattccatcccaaggcttcctgtaaaaggatgaagggcactctcatttctctgctttggtgatagcagaagcaaagcattataacatctttgtgctttttatatagatacacacacacatatatatacatatgtgtgtgtgtgtatatatatatgtatatatatatgtatatatatatatatatatatatatatgtatatatatatactctcttctctctctacttttcccagatcagttttttaaatgggccccttggcttagcaaaaggacccaaaataatccagtactctaaatataatatggggctgcctctgtccttatgttatgttgaagggttaattacaaaccaggcctcctgattgttctgtgataatgggagtgggtgtcaaagtttctaaatgagttctaccactagctagctgttccctggggaaaccacaacacttctctcttgtttctttatctgctgagttttattcaaatacatgccatgaaatcctaacctaggtcagacattgagctgggatctggcaacacaagatagataagacttgcccttgtcaaaggaagaggaagccactgctagagatctgaaataaaatgacaaagaaaaatgccttccttactagagtgagcgggggctgtgctgtctaggcacagtttgcctaagaagagcagaatgctgacctgaaactgcgcttttgggaggtatggagcctcacggattggtggatttttgagatgtgggtagatgacaccctctgtatgagaagctattgctgattggttgttcctccaatgcgtatttactgaaatgagtccatctctggtggcctgactttcagaactgaggggctaacaccaataatctacacaggtactatagacatccaggaggtagagacagtgtgaactattttaccttctattattctaaccctaattgccctcccatccttattcattctatatataattaacaaaattaataatcctctgactctcaaaattataggctaccaatgatactgaagctattcatatatttgattcctgtatgatccttgcagcgacctacacctagaagagaaacctatgcaaaaagactctatacatgtagacaaacaacagcaaaagcaaagcaagcatcagtaggatacgtagatgaatagcatgacaccatttgccaaacagtacaccttcatgtcaagaggtttgaagccttttacacagatctaagacaattccctaatggtaggtctcttaatcaaagatctagttacttgacacaaacacctcagccttgtgaccttatatgagaacatacttggttacaaatcctaagagaagaaaattttaaaatatattgattgagatgagttgcccttgatcagtagactaagtctaaaacttgttccgggctaaagagcactcagtcttttcctaagtgcgtgggaacattttcttctcagtctgtctgtgttggtcctcattcagccaaagctgcaggagagatctccgtgattatccagattgtcaccactgtttttggtcctcttaatgatgaagtttcatctgtggagatgtgatgttcacattgcacgttgatcaacatgagtttatgctattttttagatcatctgttgaatcatctgtcaggacagagctctgcagaagcatgtaaagttccgaacaacagatgctgaaggactaccagataaacaagaataattataaatattgtaagaagagactggaaaatctcccaagttcttcttcttagttccagtgccttcttagtcaattctttgttgaggagctgtccttgacccaagacttcccagctttgatcaggaaagcaagtcccaaaagtttcttgtgtatctgttaggtagctatgttcctttttcttctagcttaaatatagattgttttgcctctgtcttaatccaggtacaacaagaaatggtagctatagggtaaactcttccatgactggccacaaggaaactgaaggctattctattcatcatgactatttgggttaattgttgtggcctgggagcttaggctatataatattttatgtcagctaatgcaggcattatttactatgacaactttaaaaaaaaaccctctagttatccaactgtttaaatggggtcattatcttcaggagccttctctgagagagttttgtccctttggactcttcataaggaggtatagtccattgagggcattggcgagccagattttggaatggcctaacctatggccctatggagcaattaacttttcttctcagttgacattgagacacttaacgtcagcataggataaaggacccaggaactatagaagagaggtgatcaatcttagtgaagctgtaggtacgttatctgtaagtattgccaagatggtcactaattcacatggtcatctgtttgtcccgaggttcttggtttaatggcaatgtccacacttctctttctggaggttccctggaggacctcagtttagaatggtttggggtagcatcaagtcatcaaataattcacatttgttgtccatttttagagtacctgaaggagatgtttctatagtatgttaaattagtgaattattctggaggtatactaattattagtctacatacattctgtttcatttttttaacttaatatggacctactggaaaggtccataatttaagcattgaacaacttggctttgggtaagaaattaaattttatgggagagactggactacttattatatatcaaacatggtattgttatttttgttttttagcataccatcaacaaacaatatttcattggaatttggtactagaggatccaagttctgtctggagccaggacactttaattatagaaatgcagttatgggattccccttccttgtctaagggtttcctagctgcggggtgatgcatgttacaccaggagaaggagaaagtaaccatgaaccattatcaatcaatgagtagaaaaatattggatagtttctgttagcaattggggcttattacatgtggtatataagatttaaaggcctaataccaaatgttctgaagatgtgttgactagttgaattgatgcctgtaatttctctgagacaagaaggcaaagcctccaggttactgaactaagcggtgaacttaaaataagcaatgttctttgacaggtgctatgctgtcaccttaatccacccagagcatggccccatattttcatattcgcatgaaaaggaatgttcatgataacctaggaagaatcattcttaactcttatgcattctacttcaattaaattttctagttgtggagtctcttgtccatagagattctagaaccatcagtatttctatagtaatttttaaaattacatgcagtgtaggcattctcacgtcagatcaggtataatctcatcatgaacaagggctgcagcacattttatttggaagcagatcctacttattgcaggtatgtcatagattaaagaagtattcttttgataatgatctgaaaatatcagttataagttggcacacagaattgttaaagattgttactacttgaattcttccattaagtaaagttgattttctctcaagcctttgaaaaatttactatatagccagaaatttgtcaatttgtcattcattatcttgtttcactatctggtataacctataaccaataggttttttttttgtttttttttttttttgagacagagtctcacactgttgtctaggccagagtgcagtggcataatctcagctcactgcaatctccacctcccaggttcaaatcattctcctgcctcagcctcccaagtagctgggattataggtgtgtgccaccatgcctggctaatttttgtatttttagtacagacaggggtttcaccatgttggccaggctggtcccgaactcctgacctcaggtgatctgcccacctcagcctcccaaagtgctgagattacaggtgtgagccactgtgcccagccaccaatagctttattgaattttttgtttgtttttaatttttaaaaacttgctacaattttcttttttgcttttcagacaactttaaaaatgtacatggaatgatctgttgttctgtaatagtggggttactggtagttatattgacacccacataaacaaaaacattatatagttgtatatctagttacagaaaattctccttggaagtttaaaaagacaaagaaattgttgagtgacaataacttccttggagtggctttattagatagattgtatatagttgtcattttgctttttggccaacacgagatgttcattctttcaagggtcctcctgctagcaatatattaatatatacagggatccttatctcagctctcaaatctttgagaacagaggcccttttggatgccttatctagaaagccatatcttgtattgatttatagcatttactttctaagcctatctggaaatgtctagccccatattggatattttgcaaattggcaatttcacatttcagtttattttttcttattaaattcccaaattcaggtttaagcccatttatagaaagatatgacaagactatacttcagctgttgggtatacacaaatatgctgcttgaaggttttctgaagtctattttctatctttattcagcctcccgagtagctgggactgcaagtgtgttccatcacacctggctaatttttgtattttttatagaaatagggtctcaccatgttgcccatgatggtctcaaactcccaagctcaagtaatcctcctgccttggcctcccaaagtgctgggattacaggcgtgagccaccatgcccagattcatttagtttactttgaatctttattcaacctctccttaaaagaaagccttctaaaattactttacataatatattttctatttttatatttaaattttcacaactgggttatataactcttctattttctgtgcttctttttttttttaccattttttcttatctaagaggattttagttaatttaactaattagtacacatctatagttcaagaaaataaaaattttgtttgatattctaacaaaattataaattctataacaaaagtttagaaaatttttctttctttttcttcctttcctttcttttccttcctttcctttcttttccttccttcttttcttttctttctttttttgaggcagggtcttgctctgttgcccaggctagagtgcagtggcacaaccgtagctcactgcagccttgaaaccctgggctcatgcagtcctcacacctcagcctctgagtagctgggaccacagggatatgccaccacacctggctaatttttaaaatttttgtggagatggggtctctctattgcacaggctggtctcaaactcttgacctcaaatgattttcccaccttggcctctcaaagggctgggattacaggcatgagcccccatgcctggcctagaaaatttcttaattatagctcttagctttagacaaaggttttaattaaattctataaatctgatttttcttctggtaattttataatgtgattgtgtttttcctgagaaaaccctggttcatttaggaagtcagataaagctgaatagaaaaatacaagatagagatctgcaaagaggataggtttgggaaggttacaaaatctttgagactatcttagttaggattttcttttaaggactcaaaataccaattaaagaggctgacttttagccatttgatgtttgtctcctaatttttctagagcttctcttaaatatcttaactcactaatttttcattcatcagatgtttttcattaagtaaaaaaagtttggcatttgtgaagaaaattgcaagacttaggatcataatgcaattttaaataggaaatagaaattcttaaaaaagaggattgagatttggacataaacaagccgtggcacatgaggaagaggcaactgtggttggtcaacagttcatgcttgtgaatagtgtctcagggtcctggaccaaacagatggagaaggggacacatgattgtccgcacaactatcattaagctggaaaacaacaggacaaagtgatatattttcacaagtcgacaagtcaggaatgccctcatacgagctttgtaggggaccccaagcaaagtttgatcaattgctttttcataaattggtcactggcctaataatggtcttcaaatcattagccctcaggtccagcttgaattagattggaaacttatcaagccaatgccttatagaatagttccttctgtattcaacagaagaaggagttccaggacaaaacaaaaacccatgcaacaagactttgcacatgtagacaacacacaagcaaggcaagaggccataggataagtagattaatggcatgacaatatttgccagatgatacaccttcatggcaagaggtttaaagctttctacatagatctaagacaattacctaatggtagataggtagatctctcaatcaaagatctagttacatgatacaaacacctcagccttgcgaacttatccaaggacatagttggtcacaaatcctaggataacaaaatacattgagcaataagagcccagtgaaactaggcagaactcaaatccttgttgagactgatgtgcttggctgtggacacaaagggcaattgagtttggggcccagtgaatgcacttgtggcccaaggatcccacggagagtcttcaaaatgacttcaatggagcctccagaactgtccaggggcgatgccactactgctcagagtctgagatagaaagacaaagctgaatctttgactcagaatagcgagaggaagctatgcttgtcagcagtctcccagagcagagcggaatgcccatcatccatgattcggggcagtgtggggttcagagactggaggacactcagagtagcagcaggctgacatcagctgcagaacggagtttactcagaatgaggctttctgttggatggggttttctgatggaatggggttttctgttggatggcgttttctgttggaatgggattttctgctggaatggggttttctgttggatgattggtgctcagaagtgtgtttattggggtgagtctgaccttaattggctgactttcagaagtgagggctgacacagattagttggtttacaagtgtatattcccaaactgcatcatccttgattgactgaagaggtttaaacaagaaaaacgtctgcttgttatcagttatagaacaatcagtcttgtcctaagtttgtggagggttttgattcataccctcgtggaggcttccttgatgtgtaaggccatttttagcttaaacatttttattgttccattgagctcctgtgacccatctctcattctgacagtgatgtggtctaacttgcaaatcacctgaaaccacacttccaaggtaagagtctataccttaacttcaatacccattattgaaggtaatccattgactatctaggacattattagacaggcaaagcagagtggttggatgaaataaaagaacataccagatttgtgattaaccagtaaataattatttagcatgcaatcattttggaaggatgaaagctctaacacatatgtacctgtccccaaagaatttgtttattgggggagatgaggctaagtgttcatttagaaaaaaatttatatatgaatcttaaattgtgagctatgtactttatgtgcatttcagagattattaggaaaaattaatttggcttaactattcactttttaaccctatttcctctctttctgtgagtttactaatgatcaggttgaatgtagtaattaatagagcgttattgtccagattcaattaagtgctttattgcaatcatggattagaagagagcaaagagctaaggagtacataagtccaagggccatagagtaagaaaacaattccaccatttgagggcattagaaacctgaaactccacaaacaaccaagaccctcctagcagctggagactctattgtcccaggggtaccattttaaatcagtgtcactctttcttctgtcaagtgagttggcattgaatgcagcaccaaagatggcccagtaaaataatcaacatttcacaaggtaatagaaaaatatgcttttctgaacaacgtggagttctatgactaaactctaaaaaaattctaagccctaagtgtcattgatatcaccagtgtgatcatcaccactgtgaacagtatcttcagtgtgaccagcatctccagtataatcagcatccgtggtgtctccagtgggaccagcatccccattgtgaacagcatctccagcgtgaccagcatccacagtgtgaacgacatccacactgtgaacagcatccatggtgtcaccagtgtggccagcatccacagtgtgaatggcatccatggggtcaccaatgtgaccagcatccacagtgtgaacagcatccatggtgttaccagtgttaccagcatccacagtgtgaatggcatccatggtgtcatcagggtgaccagcattcacagtgtgaacagaatcttcagcgtgaccagcatctccagtgtgaccagcatccccagtgtgaacagcatctctagtatgatcagaatccatggtgtttccagtataaccagcatctccagtgttaccagcatcctttatgtgaccagtgtgataagcctccacagtgtgaccatgtctcaagtatgaccagtgttaccagtgtccccattgtcactcataaaaatgtgccaaggggaaggagactttccagagggttgaagagtccagctagaattcttgttttattgccgtcttgggacaatatggaaaacagcttccctgatattattagggggttgaattctgttaaggaaactggtagctttccctctttcctttatgctgaaaaattaagctaaatatggtttggatttctataaatgaatcccctcaaatgcatttccagatatgccttgataaatcagtaaccaaaggtaactctggtttcatctagaggtacagaaagtgagattttcaatgcttattttatatgtgtttttaaagtttggactattatggaccattggtttcattatttattatcttcttttaaatttaatctagtgtacagacttgatgttatactgttttgcaaataaatgtcagcaaagctcttctacaaatttggtaatttattcatcaactaacattgccttaaccatagtgttcctattttcacctgttattccatgtgatagtaagtcagttcctttcgagtccactttataaatgctgccaagaattagttaagtgggttagattaacctgacaattctttgcctcaaagatcgtatgctctttgagaacaaactgagtaaatattttttaaatgtactagagtcacagtatgctggagaggggaagaatactatttaatgttaatgcagtctcactcaccagagaatgaatgactcagaaactgtcgcacattttgattggatcaattaatttgctaattcagtaaatttatgattgcttcatatttaggctgcctcatcagtagacactcattatatcagttctcccaagagctaaaaataggaccagaagggaggaagagcttcctttcccaggaattccactccttgagagaaggaagtgaactggagagcctgattctgtgggaacctgccctgtggaggccttgggggcaccccacaggagactaaaagactagggtctcagttttacataaatataggggtagaggaagacacagaatagacccagagagaggtgtccttgttactggaccgcctcaaacagtagaatatgctatggggcacagcagtaggagctttatgccagaggaaaagttctaacattatagaggggacttacgtgagcccagaaggttataaagatggtagaaaatgtggtcctaagtgtacaggattttgataggaacttaggacacttttgatgaagtgtgcacctctgccactaagttgtgcatgccatgttgcctgctcgtttctgccactgcctctgttgaacagacagcaatagggagtccatcttcatgatgtcaatttcatcacatctggtcctttcatttctaagaggtaagcaaacacctcagctctgttgcctggtttccatatctgagagcgagtgccacaggccttcaggttcccacacctatccatcgaagactttcccttgagtggatgtgcggaatccaggcctgtcagtgtccaggctcagcctagcaggtagactgaggtggctcctcataaagctcctgcttgtcttttacaggtgaaggactctgccaaacagccccagatggtgttcacggtccgccacgccaccgtcaccttccagccagaaggggacacgtggcgggagcagaaggagcagcgggccgccctcatggtgggcatcctcattggcgtgttcgtgctctgctggatccccttctttctcaccgagctcatcagtcccctctgctcctgtgacatccccgccatctggaaaagcatcttcctgtggcttggctactccaactccttctttaaccccctgatctatacggctttcaacaagaactacaacagcgccttcaagaacttcttttctaggcaacactgagggagaggaccaggattgaaaaaagtttcttcccataattcagtggaattcccagttcatccatttcccatccccacccaacagccatgtggacgggatgaatcctcaccattctccagggtcatcttcagaactgcactggcctcttttccacctcctcagtaggaatatgactcctcatagagttacggtgacatgatgtatctaacttatctactatccctttctctgtgctgacagtcatggtctttgcccgcaaagtgtcctttcctccccaaattcactctggcatggtgatcgacattgtcttaaagaagtcaaggcaaataagaaggaggaggtaaaacaatatgggcaggttgagattgaatagaaaagaatgaacaagtcatgatgtagacctctgagggtaggagaccatagttccaggctttctggcacagtccccatttcaaatattctctgtggtcctagtacatatatcctaatactgatggggtatgacccaagagttgaccacaaaacactgtctccaaatatattaaagtatatagtcctatccatgagagcagggaatcttagctttaaggttttgtttgtggcaaccacacacgaacatacacacacacacacacacaactatgaaagaggcaggtgttctagctagctagtttactccaaaatgcaatccgttgacatgaaacaggcactgagggtaactacttcctttcattttgaagcaacagtttataaacaggaaagtctactggtttcatagaatctgtcagatttgtttatttgctactggtttcacgcgcgtggactatattccagtgtttctagtcaaagacctttatcctcaaatcatgagattagagtaaaacaactgctgtaaggttgagcatttcatgaccaatgactatgaaggcacattcaccaaacacaggcactttaagggcatccttgattaatttgctaattgctattttttgttggtatgtgaattcctgctaggaggccgaggctagtaggcaatgaaaaagacagaacaatggtaaaatgcagccccagtcctctacaaattgacagtataatttatgaggtgaggcagttaagtgatgatgcagcatttggatgatcatgtaaaaccagtgtcattacacaaaacttaaaaaaaaatcctaggcaataaaactgcctgtggtctgctatgtctctgactcttcaaatgcatgaattaaagaatgatataataatctctgaattattgtaattcatgtagtatattgtatataataaattatatcaattaagagttcaaacataggaaatttgtgataatttatatgtggtcttggcttgaagtttagtcttgtctttattgcaaagactagctttatcaaaagaatgtgagcagataaagaaatgttagacacctgtgaagtcacaattaatatgctaaatgcagatctttatgcattcaagcagattcattgagaaatttagtgataagaattgaagaatttatttagaaacgtccttagatttttcatctgtatatatcacttgaagtgctaaacccacaagtatttaaaatacagactcttcacttactcaagttacttttccccattattactcgaaatcagagagaataacaaatgctattgttttctagtgttttgaataagggaagtgtttgaataagggaagggaagtgtttgaaaaaccttattaagtaccccatggcagagaagaaaaattcagacatgaggagtctggagaggtaacactagaatcaagggtaaacgcttaagtctattctacctgaaaatccatgtgaaaacttttaatccataaatcgtgagtgtcttactgtttaaaaaagttcatactcttcagtaaagcgaagcttgaggaagatgtgccacatttttctggtggcttcaaacactccccaactctccaaggattctgtataccccagttggagaacgatgttattataatattaattcaatctccagctgagggttttattaatgttttcataagatggataagcctcattattcttatcactcaatatgtatttaacacctctcaggtgtcacttaaattatacattatatacaacatactccacatacactatctagagcaagaaacattccacataagagaaggaagaagtggcaattaatgaattattttgcttccatttcaatagtaaaagttgtttataccctggtaagaaatgtagacattcattgactttgagtctctactatgcaaatcaaatatttgtgaaacactctcatttatgcttgactgctaatattttatcaggttagaaatttatatgaatcataaacagaagtaattgctcaaaataactaattgtgttcccgtgccagattgcaacaaccacctttattagatggtgcacctagagaaggctggagggtttcctgcaagccctctctgtagggtgactgaggtgaaccaatccaaagccctcctttcagctcttgtagaatatgtcgaacaaaacgcacagttctgccctcctgcctaaagacaaagtacaaaggagataatcctctccttatgagtgatcttagccctcttgaggtcactatcagttttatattttcattgtgcggtagtgaaagacaagtggaagatgtccctgagtctgtattgacatcagaccatattgtagggattaattcttgataaaaaaaaagcttgttatttctctcttcttttcatgaggagcatttttgcttccgtgtttgtctgttggatttgcagttccctgctcacagccaaagaggctgtagagacaacactttgccatatttctattaaagagaaaataaagattgagtccacagctcaagtgctgagtgaaagtgattgccaagcagggatttggttggcatccgggaaaaggggaatgggtggccttctcaaagcctctgtcctgtatcaggaaagagattctcctgctctgggctgctcatgggctgggcactgatggttcactggggccgtctgtggtctgtagctgtctttcctgccttcatgaggcacccctgtcaggacattggtgcccaccgtccccactgtgccgggggtgggggggccagcttcaggaggatgaaggtccagcctggccactgtcagctgattaaatggctctgtcaggactgccagccccaggtagttcttttctagcagtctcgggtgctgtggtccagctgcacccagccttccatcttcctctttctcctcctgaaagggatttgcctttccatcaggtgtatctttcaaactcattatcccttctgtcatggcctcctttgcgatagcttgggttggctgctagctgtgttcattgagatctggctcaaggctccgcaagcaagaggaaggaatcaaggaagatgcaccacaacgtgcagcaaatttaatcagcttccccacaaccaagcaaataatcgtcaatgtttattaagccctgaccccatacagggcactgtgccatgcccttcaaagccacccctatttggtcctaacaataacccttggaggcactatggagatttaacacaaaagtcatttgggtcttgtaaaaattaaattattcatccaagatgaaatggctagaaaattagagccaggatcagaaccctaggacctgactccaaactccagctcttggtcttcgtactttaacacagaaacagcccctaaaggataagaaatgattggcaggagccagatgatggcagggacttaaaacaaccccttcctcccctctggcatctccaccaagtacagcccacatagagctgcaaaagcaccagctttcgcaggacacctttggaacagtgtccttttcctttatgatatttggtgactggaggtcaacctcgtgtggcaccagttcccagaccaaatctgccccagagatcaggaacaacctaaccgtgatctacactgcaccaatcccaggtgacctaacaagcaatccccggtggattagcgatggcagatgggaagtaggggagatgacgactctgcccactggtgcaaataaggggagggtctgagattaatgtacagtcgcaggacgcataaccatgaggatgtgctgagaaatgcatcattaggcaatttcgacattatgcaaacgtcgcagagtgcacttacacacatctagaggggacagcccgctatacatgtgaggctgttcggtgtagcctcgtggtcctaggctgcacacctgtgaaggctgttactgtactgaatgctgtaggcagctgtaacacgatggtaatgggtttgtgtatctaaacatatctaaatgtagaaaaggtacagtaaaaaatgattgaaaatggtgcacctgtacagggtacttgccatgaatggagcttgctgcagtggaagtagctccaggtgaatcagcgagggagtgagtggagagtgaatgtgaggacctaggacacctaggacattcctgtacactaccgcagactttgtaaacaatgttcactaaggctacactcaacttcttctttctttttttttttttgagacagagtctcgctctgttgcccaggctggagtgcaatggcgtgacctcggctcactgcaacctccaccacctcccaggttcaagcaattctcccacctcagcctgccgagtagctgagactacaggcgcccgccaccatgtccggatttttttttgtatttttagtagacacagggtttcaccgtgttagccaggatggtctcgatctcctgaccttgtgatccgcccacctcggcctctctaagtgctgggattacaggcatgagccaccgtgccctgctgaagggaagcaatttttaaatgaccaatgttaattaccctagtaattagctaggaatgggtgggagctggaattaactagaattaacattcctagtaattaactaggaacgggtgggagctggaattaactacaattaacattcccagtaattaactaggaatgggtgggagctagaatttgggacagaatttgacatttggcaagccccatagttgtgaagatttaaataaaaaaacctctcttggttcttgtgcttagaaccttaaatggaaatacttcaaattaaaatagtaagaattttgataacaaacagatgtcttcctgggggtcatcttgggtatttagaatgacatctacatgtggtaagaataggctgagggggaatggggctttgcatgagaaaaaaaggatgaggaggggatattgagctgaggagaaacacggcagcaaattgaagtgagtctgtaacttgccagccattgagtgcttcatcttggaagcgagtcttccagcctcagtcaaaccttcagatgactgcagccccagctggtgtcttgactacacttgactacatgggagatcccgagtcagaacccaactaagccactcccaaatttctaaatcacagaaactatcagataacgaaggattattgctgttttaatgtaaaacaaactaaatatgaaactcgaatctaatactaaaaagagaggataaattcaatacaaaagaaaggatatagaattccattttgctatattctgtttcatgcaaactagatatggatttatataaactgggttaatttaatttaatacacaaatataattcatcaaattataaggcatcactttagtactaaggtagcagatttaaaatacacttctgtttataaaaactcaattcatgtatctggagagcacttggaactctatttgctgagagttttcgccaacatgtgtgatgggtgggagggcaaggcaggaggaactcagcccttggctgcctaccctggatcaggctgctgcctggagcacagacacacaaagcattagtggccacatggaaacagactgcttctctcattccttcctgctccactctttggtgccactcctgctcccctatttggtgccactaacctgggtgtctctccctggttaaaaggaagagagtgtgtgtgtgtgtatacatgcacacacacacacatacacatatacacatatgtatgtatgcatacagaagatttccattaatcaaacattcagtagtaataacaaagctgcaaacaaatcagccaggggtcatcatcaaaatgaggcctaagtggcacagccccgcatgtctcagcctatggcataacaggagctttcctgactcaggagtggaaggtacaactcattacaaggcctttacacatcacctaatgtgaagggccctgcccacagctgctgagaccccggaagccacctaatttgaggcttcctcccccacaactcactgagtgagtcatattttgtgcacagagctatcacctcaggctgtatcccaaaggtttctgttagcaggaaggaagaatatcgagccctctgtgtgcaggtgaacaaactttgagactgtggcatttacagcaacagctgctccagtgatcccatctccaccttcagctcagttggaaactgaacttcgggggttagaagggaagagagtcggtgccccattggtttgttaccttcccaacatgcgacaagtcagtttccacgtagatgaaagaggaggtggtctgatttacaaagacagatgagcccccagcttcctgtttggccaccgacgggctcactgtcacctcaccgagggtgcctctgtcctgtcccagcaccgttaaggtgcaatgggtccttggtctaggagtgaagacgatgggatgaagatggggggatggagttaaataaaagggcctgactctcacttcgctttcttcatccttcctgctccttaagatagttggatgtttttcccacttggtaaagttattcctacaattggcctacaggaaaaggaagacaggcaaaacaaacaaagcgtaaaaagactcccctggcctggcagcaatgataacccacaccattgacaccagtatgttcccttattattttacaacaaaagggattgccttttgatataaccaaatatggcattttagaatctttttgacagggttcagtttatcttgttgagcttaatttttttttatgtattctagatccaagttaatgtttaattgaggctgagaagggggaagggctagaggaataactctggctgtgccctgtgatgctttgcaagtgcagctggaggaaagtgcctgtcagtgcaaccaaaaccacatttgatagaacaagaataacagcccagctctttgatccatttaaataggaccaacaggtgcatatgagagaactgggtcaatgggttcttagtgtccagaaaatatgctaaaaaaaaacaaaaaccagcttggagatcactctgtgtgtgtgtgtgtgtgtgtgtgtgtgtgtgtgtgtgtgtgtaccctagactctgtgagtttaaaatgaaccaaaaagtagggccagcactgtggctcacgcctgtaatcccagcactttgggaggccaagataggcagataacttgaggtcaggagttcgagaccaacctggccaacatagagaaactctgtccctactaaaaatacaaaaattagccgggcatggtggtgggcacctgtaatcccagctactcagaaggctgaggcgggagaattgcttgaatctgggaggcagaagttgcagtgagctgagatcgtgccactgcacttcagcctgggagacagagtgagactccatctcaaaaaatatgtatataaataaataaataaaatgaaccaaaaggtagaatacacaggagctctcattacagcagagtagcttcagcccctgtcacacaacatcatcagcttatggtcactaacatcataacgttctctccgtttctggatttctgtattcccctccactcggctgtttgcctattcatgcacaattatgacactttaaaaaaataccaacagaggctttagagttttttatgatacttagttgatctttgtgttagtcaggtgctacggtttgaatatttgggtccctccaaaattcatactttgaaaactaataacccaggtgatattgccaggaagtggggtctttgggcaatgaggtcacgagggtgcagccctcatgagtgaaatttgtgtcctgataatacaggcttcagtgaattgccaggcccttttgcctttccatctcttctaccaccatgtttgtctcttttgcccctttgccttctgccatgtgagaacagagcgttcaaggcgccatcttggaagccaagagcagctctcaccagacactgaatttgctagcaccttgatctcggacttctcagcctctgtaactgtgagaaataagcttctattccttgtaaattactcagtctgagattttgttacagcagcaggaatggataagacttcagtgttcaccaaagaaacagaatcaaaattatacgtatcatattacatatttatgtcttaatatatctatagctatggctatattatctacctacgcatgtatgtatctatctatctacctatctatgagatttattataagagattggcttaaacaactagagagattaagaggttcagctggcaaactggagaacttagagagctgatagtgtaagttccatcttagtctgagactgaagtcacaaaaagaccaatgccccagcttgaagacagtcaggcagaggtgggaactctcctttattccacctttttgttctactgaggcccttaacagtctggatgaggcccagtcacattgaggaaggtgacctgcttcatgtatctacaaatttaaatgttaatttcatcagaaaacatcttcacagacacgtccagaataatgcctaacctgatatgtgggcatcctgtggcccagtcaggtcaacacatgaaattaaacatctcatataatcatcctcattgttcttcatggcatggcttttctaatattgttaaataatattttccaattaaacatcatcagcttgtctagctccaggtacaatactggtggcatttttattgggattgtattaaatgcctcaatgcctaaatcaaactgtaaacttttggatagtcttatccaagaatcagggctgtcttttattagattttaatactctcattctttatcactccctaagccagcttatcttgtctcagctgcctatgaaaaatgagtcaagggtctcaaatgtgcagtcaggctactcacatgtcttgtggtttaggagaacagagagttctaaccgcagtgctcaggtcaaatcttccagcaagcatttatttcctagaacaaagccttctcaaagaacacaggtttccacctcatactggcttctcttaccttaaatcttttccagtagaagcagaagaataaatggaatctaagactgaacgaatccccagctgggtgccaccctggccagccttgcttagaagagcccgagagccaatgaagtcccctatcacgggcagctgtcaatgtaggaactatttctagaggaagttttctccttttgcctgcagtcccagctgctcaggaggctgaggcaggaggattgcttgagcccaggagatggaggctgcagagagctgtgatgtcactactgcactccagcctgcgtgacagagtgagaccctgcctcttttccctcagagtttgttttgctatacccagaactttcctgacggggttagtgtcactgagattttcccttacagctttagggagcattatataattgtacactggctcaggctttcttaggacgacaacagtataagatggactccaggctctctgcaaggcttcttgctccaaaaatgcactgtagaaattgttgcttttgccctaaaaagtcagagacacaaattctatgtagctggaagagaatgaatttctgtgcccagcttgtggcagtttatcacagcagccacaggaaattaatagagacagcgggtgcccttctgctaaatcctgcatcctttcatatcatcaaaaggcaaacagtcattgtttttgtgaactgggcaaggtgttagctctgtaatcctgaggttcgcttctctttgcattagggaactgtggtgttctgagcagagttctttgcacctagtggtttggagaggactcaagctcccgaggcctcagtgccgtctggctgctactatgcgcaagcatgcagtccccatgctcctaccccaacactaggaattttcttctcccatcccccactgcttttaatgatgtgagtagttatggttctgtgggaatgcgagagctatctgaagtattgcgacttcaaataacttcagttcacttacatgaccatggtgaccacattctgaaagatgagtctaagattctgggagcacattcatatgttgttattatgccacctggtgatcttgaaacttctacagatgtggggatggggttgagatcagtgctgatgttggtaagatttactacattaaaccaggtagacttcctgcatagcaagcttgcatgtggactacaggcacagaatgaaacttaacccaaaacaaggtatctagttccgtgactggtatttggagccatcagagtgcttcccctggagcacagcatcctggcctggggttgctcctgctttggccaccttttcaatgtgctcaccggggagccacgggttgggtatcttccttctccatcctgagagtcagaggctgtcatcttgcctcgtggtggtggcacaacctctcccccaacctgcaggtccctgttcctccactgtcgtcttagccactcctgtgccagttttgtcttgtactttactgcctgttgggcaaggcaatgtgccatggtccctgagccacctgcacatgcttgctgaccatgccaggaatgcaagacccttctttctctttgacaaagcatgagcaccgccatcttggacaaacaccactgttctaagttccccttgatttaaaaactgcctaaatccagcccccaaacatcagcctaatggctaatgtcaacataaccagaaacatcccaaccctaagataaactcctctccggccagaaacacgccaaccccgagatgcctccctccgaccagagatattccaacctcgcaatagactttccctcatgtagaaacattctgaacctacgataagctaccaccttccaaaacccttaaatatccttagtctgtaagagagaacggtcctgacctagattggccagaagtccctctcaggtttattctctgaaatcaacctgtctttgactgtcgagccatttttagtttttctttcctctttctttaactcttatgctctttacttgggccatttctcaaggtagcatgtgcagtgaacaaccttgagagaaaagataacactggcccctggacaaggagcaggcttgcttccacttgacacaaaggcagttgattctccaagctcaataatcctctcctctaacccaatctcttgcatgggcagcatccacccaagctcacttgttgctcccgtggaactttaaaacaatctattacccattttattgattttggctgaatgcatataaattatacatttgaattcacattaatctgtaaattaatatgacttttaaacttttctagataatgcaaattaaaaatatcatagtatacattagatacaattttatggataggacacatgcaaattatttatttatttttttagttttttattttttatttttagtatttattgatcattcttgggtgtttctcagagagggggatgtggcagggtcataggataatagtggagagaaggtcagcagataaacacgtgaacaaaggtctctggttttgctaggcagaggaccctgcgtgcagccttccgcagtgtttgtgtccctgggtacttgagattagggagtggtgatgactcttaaggagcatgctgccttcaagcatctgtttaacaaagcacatcttccaccgcccttaatccatttaaccctgagtggacacagcacatgttacagagagcaccgggttgggggtaaggtcatagatcaacagcatcccaaggcagaagaatttttcttagtacagaacaaaatggagtctcctatgtctacttctttccacacagacacagtaacaatctgatctctctttcttttccccacatttcccccttttcttttcgacaaaaccgccgtcatcatcgtggcccattctggatggtcgctatctcttcggagctgttgggtacacttcccagacggggtggcggctgggcagaggcgctcctcacttcccagacggggcggccgggcagaggggctcctcacatcccagacggggcggccgggcagaggggctcctcacaccccagacgatgggcggccaggcagagacactcctcacatcctagacagggtggcggccgggcagaggctgtaatcttagcactttgggaggccaaggcaggcggctgggaggtggaggttgtagcgagcagagatcacgccactgctctccagcctgggcaacattgagcattgagtgagcgagactccgtctgcaatcccggcacctcgggaggccaaggcgggcagatcactcgatgtcaggacctggagaccagcctggccaacacggcgaaaccccatctgcaccaaaaaatacaaaaaccagtcaggcgtggcggcatgtgcctgcaatccgaggcactgggcaggctgaggcaggagaatcatgggagcccgaggcaaggatgttgcagcgagctgagatcacagcagtacagtccagcctcggcaacagagggagaccgaagaaagagagggagagagagagaagggagagggaaagggagagggagtgggagagggagagggcaaattatttattttgtcatactgctagtgttcatttttacagagcagcaaggactttacaacccctgagtcacaatacaatttacaacactaagtaaacaagtgtatctcaacagcaaatactgcacctgctttaagacacaccctaacatataaatttaaataatcttgactgtaaactgtttatacaaatcagctgcattagtggttgtcttggtttgtgctgctataacaaaacaccacagactggttaatttataaagaacagaaatctatttttcacagttctggaggctgggaaattcaagatcaagacaccagtgggtttactgtctgctctctgcttccaaaatggtgccttctgagatgaacgttgcataatgccccttttacaagggccttaatcttatttacaaggaagaagcccccatggcctaatcccttctcaaaggccccacctcttaataccatcacactggcaacacctgagtttacaggaggacacattcaaccatagcaatagttcaaagacgactgtagaaaacctaaaacatatttaagataatatctccttactactagacaacccttattgtaaaacataagccagtatgatttatattaaacaccacaaaacactgaaaattatcatcattctacttatgggatatataaaagctgccagatattcactctttaagctagtaagtttatgttaggaatgtattagagctgcagaagaagacagaaacataaaattctggctactacttttgcaatataccacattgattacttcttttaaaaaaaaaaaaagcaaaaaacttcatttgtctgtgacacacaagtctcatgtcttctgccagcagccagaaacagtccccagctggcttcctggggtataataagaccctttctggttgctgatagtttgggcagtgaggatgggaggtgaggatatagtgtttacagtgaggatacagaggtggctttctgaagagaggggacaagggccattgtgacatgggttaggggatgtgagaagactccccaggatctggtaacaaatgatgggctaggctggggctgaaggaggtcctccactgcctgcctattacagattaagactgagcagtgggaactaggattgtgataagctgctcaaatggtgctcaggggttgctgtctcttctggagggaggagaaagagatgctattgtgtccatgaacagtaagcctcaaggtcccaaacaaaggccatgtgactgtggagtcaggaggtccccaccctgagctcatggacttgccagatgctggggttgcactgggagagacaagggagatggggcgatgcccaccccagagtgagaaaccaaagaaaagcagccccccccactcaccacagcagccccacgggctggcatcttccctccctgagctccaggtccccatgactgttgacacatcccaggtgtgcatattaaactcctctgcctgtgttcccacaggaggaaatgggcctggccaaaaccctctgtaggaaggggagctaaagggacctgtgggtgtaccttttgtgccaattcgatgtaccactcttgttgcttctagacttaaatctatggtagaaattgaggtggcaaggccaaggtgggaggattgcttgagcccaagagttccagaacaggctgggcaatgtggcaaagccttgtctctacaaaaacaaaacaaaacaaaaccaaaaacccacaaacattaggcaggtgtggtggtatgtgcctgtagtcccagctccttgggaggctgaagtcagaggattgcttgatcccgggaggtcaaggatagagtgagccataatggtgccattgtacaccagcctgggcaacagagcaagaccttgtctcaaggaagaagaagaagaagaagaagaagaagaagaagaagaagaagaagaagaagaagaagaagaagaagaagaagaagaagaagaaggaggaggaggaggaggaagaagaggaggagaaggaggaagaggaggaggaggaagaaaaggaggaggaggaggtggaaataatcaatgtagtatatgcttgaacatcccaatccctacagtgccagaggggatcctcccagctggggaggagctccaggtggaaggctgcgagtgagacaagctgcgctgccacttgcccctaggggctgggggatgcattaggatccagcaggagcctccatgccctctcatgcccatacttcccactgtacagatgctgccctgcaggtcaagagacagaagctccttctaaaagaacccagttgtgatgttgtcattcctctaccaacaggggtggctgataattacctacacgtaaagtttcccaggactgtgtgtgcatatccacagctttcgagccttctagcccttaaggaaaacttctgtgtctctcacacccacctccaaaaaagcccagtgctttgtggggggattctttgaactggagacagaaatatgcctctcttgggcattctatttggttctttatattggctaactcataaaccagcacctctaagtggggtccaatccagtgagtggtatagtgaagctgtctggcgagctgtggcacccctccatacctttgggtctatacaactctaatgtcctctttagtaagctacaagtttgtgtgactgctggtcttgctgatcgaattctctggggaagggaggcagcctccactcagaggcatgcattgatactttggattcattgatttcctgacatagctactaagtgcacccctctttaaaaggggggcagccattagccttctactgagctcttattaaagctgaacatctgatgaatgaatccttgtgactctcaggctaatgtacctattatgccaatgttggtgggtgggtcaacttggacttggtctctggcaagattgcccagcagtccttgctggttataaggggatggtgtgtttgaagacacaaccagcatgcccctagtgtcccctcagttttgcatgaagggatggcagctgcccctatgaaagtgtgcagtgttgggtcaatatggctcagccgttgtttacccccacagctgacctggtcagcaaatagaggctgcccagggatagccatgaccttagaggctgaggacctcacagctgggaagaccctggggatgctgacggtgcagactgcctgctgcctgcatccctcgcagtgggctgtcagtcctctcttgaatcaggttctgcggctgcatctaccacagcgaggggttgggctgctatggaacttggatgctgactgaggcatcaaagcccattaggaataggtaaaaatgagacccttatgaaagctctctgctcagctgagtttctgatggaagacctatcggggagggcccctgtgtaattccgcttctgctgcccatgcaggacgtgttcttggttttctttatgtgacaaatcacatttcctatagggcctaccctactgtagcttcataaacattgatggcaaaggaagtagaattcatgaaaaaaatccttttacgtggtttttaaaaggaagacaaatcattacatgagaaatctggagttctactgtgaatcaggaattatgaaagctgccacttcactgaacaatgctttcgactgcaaatatcaatatgcgaactttcacttaaaaagtggggaaaatataggatctctgaatgcaaatttgggagataaagtcggcctcaggcatgagaatcatggttcagtttgttccatccatgaaaacagagtaaaatcagtcccctctttgagaaagaaaaccatggatcagaaacatggtcccctccctgaaggtgggaaccaccttctagtcaaggtgaagcaaggaaggaagccgcccagccttacaattatctaaagcttgtgtgtatgctaacacaagaggctaactccacaacctagtgaaccgaacaaaactttggcaggcccaccattcagtctgcagcagagggctcaagacatatgtgatgtgtcttggatctagtccgtcctatggtgtcctccatatgacgaaaagacgagaggattttccaatcatttcactgcaggacatgtgcgctgtgtcagtttcccaaggctgccataacaaattacagtaaacttggtgccttcaaaacacacacggattacctgacagttctggagtccagcacaggcctcactagattaaaatggagttttctgcagggctgcatgcctttctggaggctctgggggagaatctgtccctgtgacacttttagggtccagaggctgcccacattccttggctggtgcccttcctccatctcccaagccggtggcactgcctccctctgcctttgtccacagtcacacctgtttggctctcatctcctccctcatccacttcttgtttgtttgttggttggtttgtttctgagacagaatctcactctgttgccccagctggagtgcagtggcacaatcaaggctcactgtagccttgacttcccaggctcaggcaatcctcccacctcagcctccccagtagctgggactaaaggcccatgcaccaccattctcagctaatttttgtatttttttgtagagagggggtttcaccatattgcccaggctggtctcgaactcctgagctcaagcaatctacctgcctccacctcccaaagtgctaggatgacaggcatgagccactgcatcctgccccacttgtaaggatctgtgtattagattgggcccatccagataacccatgatcatctccctatgttcatattggcaacctccattccccttcacctgtaacataatcccaaattctggagattaggactggacatctttgggaggccatgattctgcctgcctcatttacccattcaactataatcttcactcatgaggacatcaaggtttgtaagacatgttttcagtcattgtgaaaagtcacagcccaagctcggattctccaggagtgcttgctcagtccagacgtaactgaactggacacaaattcaccaaggcttctgcatcccctccacctccgtcccttcttcaagctaaaccttgccattctctgagactgaaagagtcactgcagcctctggtgttctgaagtagtgggagttctgctgtcttccccacactggagttaggaagcctctgttcttccctaagcctggaatgccgagagagctttgttctttcacacattctccacctctgctgaatccggacactgcttccctttgaggtaccaaggtggctgcagcattgctggagtcccctcaacagcgacttgaacaagaaaagtgggacaatctctttcagaagtgagaaaactctccccacatctcttcccactgctcagcagacttcccctgactggctggatgggggtcacatgcccattactaagccaatcaccatcaaagaaaagtgattgctatgcttggcttgataattgtctttgtcttagaccacgagacaagggcttggctgccatatgcactttttttttttttttaacggagtcttgctctgttgcctaggctggagtgcagtggtgcaatctcaactcactgcaacttctgcctcctgggttcaagtgattctcctgcttcagactcccaagtagctgggactacaggtgcatgccaccatgcccagctaattttttgtatttttagtagagacaaagttttgccatgttggacagactggtcttgagctcctgacctcaggtgatctgcccgcctcagcctctcaaagtgctggcattacaggcaggagctacagtgcctggcctctagatgcttttgggaagtgatcctaggaagaaagattgagggagggaggcagacctattacagggtgcactcaggagcacgttgcccatgtgggcagctgggtgtctccctggggaccctgtgaggaactgtgtagaatatggctcagaactgacctgccaagacacatggaatatgggctatttatccataactctgtacccttaaggcatttaatccttgtcacttccagggcaggctaatcaaactgcccccaccccaccgcaccccagtgtgataaaaataggcagagccacagacagaggcaggacttagacagggaagctgctggtgtgcacgtggactgtctgctatagcatggggtggactcaaggtggctgaggggatgtggggcagggcactagcctcaccgatgccaggacctcccccactacagcgtgggtagagaggacagcttagcgccaggccaaacaaacccgcccaggattggtgtctcctcctgggactgcttttggaaagcacttcagagttccaaagttgtggtggtaagtgtccatgcagtgagaacatgggacttaacatgtggcttagtgggcacataggccagtcagcctgaaggctgactgaatttggaaatcaacaaagtaattcactgcagtgaggaaatgctggccagagcgttcccagcagctgtgtgtgatgggcagggccagaggcccccccacccacgaagacatagtcatgcagtattacagggacccgcctccccttggctcataatcactctgccctgacagcagctgggtgctaggcccaggtttatccctcggggggaaaagaccaggtaggtggagacttcactcttctgggtctgctccaaagaaatggtgactctgaccttggagaacacatgaagacttggggcttgaggaaaacttcccaaaaaggcttggatagggaataggaacctgacttctgcttgtttatacaaatagaaataaaagccattttaaaaacatccccagcaatttcacccaaaatcaactattcgtggacttgaagagggcaggaggtgaagcatgtgtacaggaaaaggttttattccactcacagcccccagcccagagttttcctgaagtccaggctgagtggaatgtgaagggaccatcgactgaggggctgtcccttcgcagggaaggcagcttctctttctggggtgatttcagtgtggccttactagaccgaacaccaatatcccaggtgggctgctttcaaactcattgagccatgagacctgaggactaagctctgatttttttatcttgcccaaattcctttctaaggggtctggacgcgcatgacacacaacgtttggcagtagcacacagaacaggaaacgccaactcttttgacagcaaagggttaagtcaactgattatgttttttctgtcaagagccagagaaatacttgatattcttagttgtgtttctgtaatagttaataaattacacaacaaaaacctgactatataaatctattggtctaactacgtatttgtaacttgcacagtagtcaagcccttttgttactttgccccatcgtgctcttaaagccagccttgcagatctgtgcagaaacccagccccattttttttcctttagaacagccttccccattcctcaaaatggaattgaggaaatcagcattccttagtagattcctggcttcagtttttatccacggctgggaaaggagtgacctgcaaggctgctttaaacaccctttggcgtggcctgaaatcaaagccgcacccacactggagtgcagttgtctcaaatgagaactcactccctcagggcaggcacatccaggaagtgctaagacacttaaaagttcctagtgctggccaggtgcggtggctcaagcctgtaatcccagcactttgggaggctgaggtgggcggatcatgaggtcaggagatcgagaccatcctggctaacatggtgaaaccctgtctctactaaaaatacaaaaaaaaaaaaaaaaaaaaaattagccaggcatggtggcaggtgcctgtagtcccagctactcgggaggctgaggcaggagaacggtgtgaacccgggaggcagatcttgcagtgagccgagatcgcgccactgcactccagcctgggcgacagagcgagactccatctcaaaaaaataataataataataataaaataaaaattaaaaaaagttcctagtgtttttgagacccacaattacttacaatttatgtagtgaattctaaaaattaaaaacactaaaaaaggcattattttagcctgtatgtagttaacccattcagaatccaaacatacaaaatggtttatttaaatttaggaactgcccctgttactaagaattctgttttaaagaaacagtacgaaaagaaaaattctaacccaaaacaactcaaatcgttttccactaaatactgatacaaacatgtaacaaagagtataaaaagttattcatttaaatatgtacaaactcttttaaactcaaatactgttttaatacttatcgaggatatatacgacgaggtgaagaaggaaggtaagttgaaagagaatatattgcaacagcctaggcagtactgttaactctattatactgcaaactttttgcaacaaaaatgtcttttttattccagtgtggacagggattttcctcatggagcatctgtggctctttctaggctgagctcatccctttggatttgatgaaggccatgccgtgtgtccgcatgtgagtatttaaggcagcttcagtttcaaatttttgtgcacattttgcactttctgtctgacacggcaccattgggggattcatcctcatggctgggtttgttttctgttagttatcttccccagtcccattttgcctggacattggctgaggttcctttaacttgcgtacaatgaagaagtgcctggacagcgagacatgagacgtgtagcagaggccacactcccaacactggtaggaagaaccatctgatttgtgctgagggatctgtttgtggagctgctttcctcccagtgtcttctgtgaagacggcaggatcctaagtcattaatttgaagctcgctaacaacagcacgatgaaagccatggtcatatctgctgcctctgtccagagctccagcagagccaacattaaagccaccaatgccatccaacagcaaactgtcgtgctgccagcatccagcctggccaacaccaaactcatgccaaagactgtgcaccttgccaaccctaaccttttgcctcagggtgctaaccagttccctccttggtccttggaagattttgaggcagcttctcagaaaacaagacaataaaataatcgttgtaataaaacctgtacatgcttcaggagacttatcagaatgtctgggaggaataattgcttttctgaaaatataattattttttcaactcaccgccacggttacttctcttcccaagttccaagaaacctgataactcctccccacgctaagaagtacaaaggaaataaggtcaggggcgtccaagcagaccctgtgaacagcaggagcccatactgtgctgaaggggctgttattgccattgctggtcacctagaggtgctgcgttctggccacgcccacgtcggggtgcctaactccaggaaacccattttggtctaaaagaaccataattgtatattcctcatgaccatgggaagccagtgttcactcctggtatggaaaaagcagctcactcctggtatggaaaaagtaggttggtttctgcttgggaactaaatggcttctattttctgagttccctcctgcaggtaggaggacaacaaacaatatggcggtaggtcctgtttatgccccaggcaccgaagctgagataatgttctccaaaaactgagaacatccttgctggctgaggccctaattagagattaggacacgccttacagacccattgttctaacaaatagcttatcaacggcctagctcacagggtttgcagagctaaaggagctcttaatgaatcagaatttaacacattgaatctttgtttttaaaatgttgggtttgttgtttttgaactaatcacatctgcacaggggtctttaagacaataaaagccaacaatttaaagaagtaaaaggaaagaacctgatctactgatattcaacaacaaactgaaaactgttttgtgttagaggtcattagagctggctccaaggaaagacagaatcaaaatttacccaaatacagcttttccttcatctcttctgtgtctatatcccgtagtctgtgtgaacactgatttctcctaaggtgcaaaccccactgttaggaaccatgctcccctgagaattcatacattgacaccctaacccccatgtgatggtagttggagaggggtctttgggagtgattagggttaagaagaagtcctaatatgattgagttatgattagtgtccttataagaagagataccagagagcttgccagagccggttgactgtgacttgaggaaccaaggatggcccagtgtccctgggggcaacagatgccacagtggggagtgtggtgcaggagggcaggggcagccagctgcatgccaagcccttccttgggcttgtgtgaccctgctgtgcggcttgcctctgctgttgaatgctccaacactccccttgtgacagatccccgagaaaacaacctggagagcctctaacctcgggaaaacccggcggttattttattataacgtcaaaatccaatgttcatgcactaggtttttgagctttcaaatctccagtgcaataaatcccatcacagaggctttgagtcccctgcaggttgattctgtgactaatttcccaattgtttctttgagcaggagactgccccgcagggatcagtctggggacggctctcctgcagtccatactgatggctcccgatgctgtgtctgagcagagaaggaaaaacttgaagtgtcggcagaacgcctgagactctgtcacctgctgctccacactgactggagtgaggttgtgcgacaaggagagatctgtgtgcacagaccttctcctggcaggacaggggagggagggaggagataaaaaggaaattagccacaagccatggcaatacaagaacgctcatcacagcatttgttttaaataataggaaaaaggtagaagtgactttaatattaaccagtagagaattaggtgagctgtcacagaataatacgtacaatgaaatgccatgaagtcatcgttgtgtgtgtgtgtgcgtgtgtgtgtgcgtgtgtaagtgtgtgtgtgcgtgcatgagtgcaagtgcatgtgtctgtgcatgcctgtgcatgcatgtgcgtgcgtgagcgtgtgtgcgtgcgtgtgtgtgcgtgtgtatacatgataagaaatgaggactataatttatttgtactaaaagcaattcataaaacaagaacttagagcatgagaccgtttttgcttttcagtacatatttatacaggcaggctcgccagtcctgggttacaaagcaagacatgaaggtgacaaagcttgtctctacgcgttaagattccaggtgactttatctgttcagttcaatattgtctgccactcttacggtgaatataacataatccgaaacaaaggcgtttataatcctgaaagttctatgagctgaagacaaagctgacttgtatgaggctaaaagcttctttttgtatttcaaacaggctaatttagcaacaatatttggccccataatgacaaaagaagcctaatgttcctcttaggcatttggctggaaaagcagtgctttttcctgttgatttccccccgtgatttattaaagtaataaaggcttgttatggaaaattccaacaaagtgtgttttattatctttcacagggtgagcccagcaagacatgtggctccccatctgtccggttagggttcagggacttccagggtgaggggaggagggggactttctctgttccttctctttgcctgtgtagcgcttgttgatgggtagacactaccgtgtgtgatgaattattaatagaagaagctgtgagaccataaatattcaaggggatgcatctggtttcactgatgtttcatgtaaggcagaaaaagtacatttttaccaagtggaacaacttgtcagccccaaatctcttgcttgcctggacccaagcactacaaggagaggaaaagcatcttctgacactgcacataaaagtccagctgggacacactgtgtgtgaggaatgtgcagggttcagcctggaagagaccatgtgagctgacaatgtcgccatgtttccttaatggatgtgaggctgtctgctgggacttaggggaggggaatggccccacattttttccaagagaaatacggcatttcagaacaccatttgaagacttagaagaggacaaaggagatagaagcgtccctaagggagtttgcaggtggaggagagcagcaggtgtagagttgggggcttgggacccaccaggactttgccaagaccagttcctcccatgttttctgccccgggaagattaaaacctatgcagatgtcaatgtctccatctccggggcgtatttctgcttccaacactcaccttcagaagcagataatcaaagaaacagagtgagtaggaaagtgagcttagagcggaagagaagcgctcccggctgcacctgcttcaggaagtctctgactggtgctgctcacggaacgcgcacaattctgtttctcagcgtgggacccctccagaaggaccccccacaaaaggagtggcagcctttccaaggcatgttccataaaaccccaacttgcaagaacgctaatacatattatgtgaacagaaagaggtgcagagtaaaaagaccttcgtacgtctctgagaagacctacaaaagcttaccttgtgagtcttgaaggactgctaataagaccctaatggaatggccccaggggaccttggaaggcctggaaacattttttattgtcaaaattgagggcaagtggagggcagtgactggaagggaaggtgggtgtgcttcactgacgtctagtgggtgtaagccggggaaaccaaagaccattgcacagtgcacagtacagcccccagagcaaagaaccatctggccctataggtcagcagtgcagaggctgagaaaccctggcctaagtgtattggagacaaaacctccatcccaccccggaccctccccctttaggcatctcaatggtgtcctgcaatgcacaggtagggaaacgctgcctttgcactcagctctgaaggggatgagaacatgccagtgtagtgtgaaatatgtaaagtgtctgcgtgggcaaatcttccctcaagaccaccggggaatcaccttctccccagcaggctcctctctgggatcctcctccatgcttccgaaacatcatcaagcccctgtggtagcaccatttcctcagtccgtgagctttctcaaagacgtagctcctgccctctccatctcaccggcatgcagtgaagacttcacctccaaatatgtgaatgaggctctgagccctgaaggatttggagaaggcatagcaacgaattctgatgaaacctaacaactggttaagcaggtattaagggttgcagaacacaagatctcataactcaatgccccatatcctcaaaacaaaacaaaaccaactggtaggcgagggactgtgcttgaagaaggggaggagttctgtgtgtggaagagactggaagaagagaatgttcacagtaggtagctagtcgggtgggagcggggcaggtgagggctcccctccacacacccgggatgttgggccaccatcaagtgagggtcaggcagttgttaactgtttctctaaactgataactggttgcagccagcaccagggaaaggcagtctcctaatagatagaaaacacctgaaactcatcagcagcttcctgataaggtctcaggagttgggcgaggcgggagaagtagcacaagaccctggaagtatgccagtgtctaaaaccccaagtcaaaaggtcaagccgtgcacttctctctcaggttgcctgcctggccctcttctaagtgtgctttccttcctgctctaaagctttttttttttttttttttttttgcgatggagtctctctctgtcatccaggctggagtgcaatggcatgatctcggctcactgcaacctccgcctccctggtccaagcgattctcctgcctcagcctcctgagtagctgggattacaggtgcatgccaccacacctggttaatttttgtatttttagtagagacagggtttcaccatgttggccaggccggtctcgaacttgtgaccttgtgatctgcccacctcagcctcccaaagtgctgggattacaggtgtgagccactgcgtctggccctctaaagctctttaattaactttcactcctgctctaaaccttgccttggttggtctctcctgccttctgcttcctcagtcgaactccttctgaggaggaggcaataattgaggtcactgcagacctgtatggatgctgtgagattgatgctcgccccagtgtgagggagggttggggtgtcctgatcaggagaggaggaagttcacctgagacacaggtgagtccacaaatcagcacctgtatgcgaaagatgcactactcaggggagtctcagcagatacgactgggggaaaagacagcagagaacaaatatttagctctagttgcttgcaaacattattttcgcccaatacttttttaaacacaaatattcttgacttaagaaaatgaaaaaggggttaataggactttgctgtacaagactaaacctgtcctatgggctgacctgaattaatataaatagtagatcatagtgtcttgatactttatttctatcccaggttattttgaagccatttaagcacagaaatatgaaaccacgctaagattctgaagaagcaactgtttccccaacatttttctccaggaattccaaatgtctctggggggcattcccataaggtgggtttacacttaataattcagttgaaaatgcagcctttattttaaatctttgtgatctatcttcctttttaagcttttaaatctgttctcagtcaactggttttgaaggcagagaaacaagtttacactggaattcatgtacagttaatgatctctgtactgctcactgggtgatgttttcacatactttcaagtctaggggaaaaacatgctaatgaacattatcataagttaccaaaaggtgaaagttcttttctagaactagatgtttaaaggccactgccaaactgccccgttgatttctccatgtggcttattaatgacagaaaaccaaatgaccaactattaaatttttatcaactcactaagtcatatggtacaagcccattagcctcatacttttctttccctcattccttttttgtttcttgtggtgtgtatggtggcgaatctcactgtgttcgggatagaactctgggtggccatcagtgaagtatgaggaagaaatggtagcaatgagggtctcacacacaagattggaggtggaggcccccagcgcccaaggagggcagacatcaagcccctataactggctgtctctgtggcagccaggccagggagtccaccgcagcagccaggagaggcagggaagtggctggggagccatctccctcaagtcaagtgcactgtcccagaaaactgcagacagtggaaggacagagcactcccagctgtcaggaaggggctcttgacccttaattggggacaaactcagaaacgttcacccaggattcggaggttggtatgaggactgagggcattggctgcaggtgcactgtgggtctagcttttcccctttctctaaatgatgctgtgggtgatattctcgacagcagcaccctgccctcttaaccagagagcctcacccctgaaagacagattgaagtgtatcttgttaacataaacacagagtatatgggagtgttacaccttttctaatgattgcacataagaagttaaagacttttttttttcctccagaactcttagatattattaattagatctcattctgcttattgaaagtctggatggagacccgtattcactttaagaggactgactacctgggggtgttgtatgactagggtgttattagagatatgttaaaaacacaggtcaggcacagtggctcatgcctgtaatccctgcacttttgggtggctgaggtgggcatatcacctgaggtcaggagtttgagaccagtctggccaacatggtaaaaccccgtctctactaaaaatacaaaaattagccgggcatggcgatgggaacctatagtctcagctacttgagaggctgaggcaggagaatcacttgaacctaggaggcagaggttgcagtaagatgagattgtgccattgcactccagcctgggtgacagaatgagatcctgtctcaaaaatcaaagaaaaaaacccagttacacattttactgaatagaacctagggactcaatgccagccagctatgttgaccccttttctgtgtaaaattttatgatgatgctgtgtgtatttagtgaaagaaaccccactgtcccaggggcgactgatctgaccccaccttgggtgtgtgcagagaatatcatgtctgtctagactgggcacggagaccccctctgcaggccagcttggcagtaccctgtactgcaacagagcactcccaacttaggagagggatgggtgagcggatctagcagccgctcaggctgagctgggaccccgatgaccagttagttttccatgaagtctcttgtctatagcgatttctcttctggcaagttgaaatcaggcctaaaattattagaggaaagagtagaaaagcttgatgtatacattcagctttctgctggtctccactcctgtctgctctgcgcatctgtccctggagaggcagcctgtccttcgaacagtgggtcccctctgctgtggtgctgataggcctgaagggcagctgcctctgcccctgcccttcctctgtgcagaacttggggtctccagctgggaggagttcatctccagcaccaggctctgtgcgtcccctgctcctggcttttctgtgtgcccagagactgtcagggctaaagggatctgtctttttgtcccacttacctcatctctgacttatagtacagcttttaagtttcactttcttttttttcttttgagatggagtctccctctgccgcccaagctggagtgcagtggcgcgatctcagctcactgcaagtccacttcccgggttcaagcaattctcctgcctcagcctcccaagtagctacaggcgtgcaccatcacgcctggctaatttttgtatttttagtagctacagggtttcaccatgttggccaggctggtctcgaactcctaacctcaaataaattgctcatatttacctgggaatattttatgaatttatgagcaaatagaaatgtaggtacttttccccccttattgtccattttctactttacagtatacttggtgtattattctactcacttataaaaagcatcctcaatcaatatttttatttttttctttcttgcttgcttttttttttttttttttttaatttaaagagaagaggtctcccaatgttgcccaagctggactctaactcctgggctcaagcgatcctcccacctcagcatctacagtagctgggattacaggtgtgggccaccatgtctggccacttttctttataatggctgtagttttcctctctttctgttgtagtgtgtctactaggaagcttttagaaaaattaaaacaggatgggcaaaataggctcaagtgtaaggaagggaggtctgcatttggggaatatttccagcgggctttgattgctgttattgttgtttccatggaaggtgggttttgttgattttatggctttcacggctctccagggctcccagcagccgcctggcacagcacagccttgcagagcccaggcgtgggtgggacagatcaggtttgcatcctggctcctccacgtcccaggtacttgatctctgtctaagttacccatctagtctgtcttcccacttgtagaatggggttaataacaacaaataatttaaatgtgactttcagggcactctcaagggtagcatttgtgcacagaaaacactactcagaagtttataagttaatattccatttattaaattagcacatttgtattagtctgttttcatgctgctgataaagacatacctgagactgggtaatttataaagagaaagaggtttaatggactcacagttccacgtggctggggaggcctcacaatcatggtagagggtgaaaggcacatcttacatggtggcaggcaagagagaatgagaaccaagcgaaaggggtttccccttataaaaccatcagatctcgtgagactcattcactaccacgagaacagtatgggggaaccgcccccttgattcaaatatctcccactgggtccctcccacaacatgtgggaattatgggagctacaattcaagacaagatttgggtggtggcacatccaaaccatatcaacattaaagctagctcttacttttagttttcacttaatcttaaatttaaaaaaaaaatagagacagggtctcactatgttgcccaggctggtctcaaactcctggcctcaggtgattctccaacctctactgtatctaaatccattttggaaatcacattctctccgcattctaacatttaagcattccccgcatgtaatggccaggtcctcaccttttaccctaaagtggaactggccagtcaggaagtcctgcatgcttacacggagtggctgccagtgccacacagcctgtgcagctcctgacagacaactgacaatcagcaggcactcagagagctagcggtgagacagtgaggccgagataaacaagcaaaaaatatccagcagagaagtaattccaagaatagatggcatctttggaaaacaaaactcaatattaactcgtatcctcacacttgtgtggaaatattgcatctatgccacaagaatggcatactgagaaaagacagctagcatgagaaagagctcttagaaattaagattcttgaaactataaacttacagaaggattggaaggaatggaaaatgacatcaagtctcccaggaaggagaacagaaagaaggaaaatgagattaaaagaaagctttatagatggtgaatccacgaatttgcactccaggaagcgggaactaaaaaccgcagtaaaccatcagaaatgacaaagaaatttccagagtttaactagcacaaccttcagaatgaaagggccaaggagggccaaaaatacgtcaatactgagttatacaaacataatcctcataaaattagagccccaaacataagaacgatcccaacattttccagagcagaaataacatttaagaaacaaacatcgggctgtcattcaatttctcagttgcaccactggatcctggaagactgggaagcagttccttaaacccttaggagaatctgttttaatctgaaatgagtttggctacataaggaagttaaatgtgaaaacagaagaaataatcttgaaacaaaatcaaagtttatttctcttatattcaaataccttgggaggctatctgttgaacaaaacaaggaaaaataagaactcctctattggaataaagggtggatccaatctaaaaggaagccgtgaaggggggttgcaggataatgttatggagagtgacaagaaatcagtaagtccatgtgggaacagtatgacttcacgtttctattagaaagagtggggagggttatgcagatggtgggatcctgagcaggttggaaggatttaaagatgagactaaaagaacacaaaggaagggggaaactccatcagactccaggaaaaataaaactgttaatacaatcacagtttactgtttgatctggcgtggaacagtactttcttgtactcaggatgcaaactcaacttactgattttcagcttttagaatcaactaacaggcagcagagagaagaccatgatggctgcagaattgaatgtgacctgccaaccttaacaactctggtaaggaggaaggggaggaagatgtaagacagagtatgacaaccctcatgcttctgtacaagaggctagagagacatcatctgtagttggtaacctaagagttaggcatccaataaggagctaacagtgaaccaaattctcatccttgatgagaaggaagtctgtaaatgtgaaatggagcaatggagaaataataaaagccggtccatagagatgaagacaaaacactcatggggttgggggcggggcagctcacagctcgtaatggttatttctgggccataaagccagagctggggagaagtggaggagcatagatttttatcaaaagcaactatctatttgaattttgaatcatgtacactgatacttaaattttaaaaagtcaaaaaagagtttcagcatctcatcacttttgtgcttcttccaatccttagagcaaacattggggagggactggagacagttattagacctgctacttccactttctcgcctgggggccaggagttagcaagctgggcggcttgtcgtcagggccaggaatgagctgtgagctgagcatggtttttacatttgaaaatgtttccattttaaatggttctatagggaattacccagtagactcagttttgccctcctggcactcaaagccttaaatagttactatctgtccctttttaaaaagtttgccaaccgttggtctagaggctcaccctagagattattatatgaatgtgtttaggagatggcacatgcgatgatgtggagggcaggctttgggagagatgtttaggagatggtgcatggtgatgtggagggcaggctttgggagagatgtttaggagatggtgcatggtgatgtggagggcaggctttgggagagatgtttaggagatggtgcatggtgatgtggagggcaggctttgggagagatgtttagcagatggtgcatgtggtgatgtggagggcaggctttgggagagatttttaggagatggtacatgcggtgatgtggagggcaggttttgggagagatgtttaggagatggtgcatggtgatgtggagggcaggctttgggagagatgtttagcagatggtgcatgcggtgatgtggagggcaggctttgggagagatgggcagggcatggacctgctggctacagacagtcatttctcactgcagccgcaggtcattcgaattcacaatgaagctgaagaccatgaatatgaagagttcagtgtggttgctggcatgggcaaatcctcaactgtgtcctcgggctgcagtaccctctggtggagacccttcccttggggatggagaattggaccctctagcaagagccagcaggccctaggagtcagatgggcaccaacacgactgggctcacttgtcatcatgaagtggcagctgtgagacttgggacaaccaaaagtgccaaggatttggggctgtttctgggacctggttaggtaggggctaaggtgtagacttgagaccagcagtggcagaaggtaggggcttccagcaactggagttcacagtagacacagggatgccccaactaacagaggggcaggtggctgtcaccaatggtgatcactgtggagccactgcagcaacgagctgcagccgctcagaggctgtgcagtgagaatggcaatgtaccagaagagctccatccagaagaaggaaagagtgaaaagccacctttccattctatttgtgaacctgtggtttaaaactgctggtttaaaacaccatctgctacaaacctggacaggttggaactcaggggagtggccataaatgcatcttagtcttcaaaagctgtagattgttttgtaaatccgtgttgtttttcttcctggatgcagtgatttcacctaaagaaagttgttcctgggagaaaaggaagcagtgaactgactgcaccaggtgaacgtgtacagtgacaatctagggctttccatgtggctattatctgagggctctggcctcccttaaatatttacactgttcagcttgtgaaactgcccctatacattttacaaaattaatcagagaaaaaggaaggggaagaaatgaaaataagccaagcttggagcacactcagtatccatcatgaagtcagcaggctccctgggccccttcctcatagctgtttggtgcctattgccccagaatcacatagactctgtcacagattatcattccccttaattgctctatacataacatcttgaacattataaaacattaaggcttgcctttgagatattctttcagatcctgcataccagtgaaactactgagaccagctgccgtgaaggactccacaaggagctgactcatccaagaatgcaacttccacatcccgatgacttcatcccccgtaccctgaccaatcaacgaacccacttttccaactcctcgccctccatgatccctttaaaaccccccagccagaactcctcagggagacaaatttgagggtcttctcccatctcctcatctggccaccctgcaatcactatactctttctctgctgtaaaccctactgtcttggtgtattggctgttactgtgcagcaggggtatggacctggcagtcctgtaatacttgaagttactcttgagcaaacctggaaattgtcaatagtagtgttgaagctaatgtctggacgctatgggacagcacattcgattttttgtttgatgcaactaatacaaacatagagtaaattcagtattaatgtgattttagagtctctttcttttgtgtacaaagtagaaattactttcttttttgccttttcagctacagtggtttttatggaaagaagaatttccagagcgtttcttagaaaagagagaagaatgaatttctctgaatttgaagacacctccaaacccatcatccctccttactgacctcaattccatcagatgcctgtttctgaaccaatcgtttgcctgtagggggttgagactaatcagcctcccgccaggtgaggtcagctgctcccaaggcaggagccagatacctggtctggctgaggcctgttagtaggcaggaagtagggcctgtatccatgagcaaccaacaattctcttgccacctctaggctcagctactcctcaggtgagcaaaagtggttcctgaacacagcagaaaagctaccagggaaaggggcttcttcagtaaagttaaaatttcagtcgcaatttgatttggctgttcccttgtcaattaactgattttataaaaactcctttgtacggaattgttaaaaattggcctttttttgttttgtttttgtttgagatggaatcttgctctgttgtgcagtggtgtaatcttggctcactgcagcctccgcctcctaggttcaagtgatccccccgccttagcctcccaagtagctgggattacatgcacccaccatcatgctcggctaatttttgtatttttagtagagacaggctttcaccatgttggtcaggctagtctctaactcctgacctcaagtgatctgcccaccttggcctcccaaagtgcttggattacaggcaagagccactatggctggccaaaaattggcctcttttctgtgttggaaataatgggataaaattagaaataactttgcagggtgctttaacatggcaagaactggatatatcctcgggttgggtgaagaggagcttcttagtgatgttaattggctatgtaagattccacagttcaaggcaaccagaatgtaaaagcacaattcttaaattgtttgaaaaaaaaaatgcaaccagttcttgttatttgtgatgggttctagaaagtcactgtgaacaccgaattagcaaacactgacctattggtcctgtgcaaatgtagcatagcgtcctgtgagtcctggtcataacatgttttgttactgaagtaccatttgtatgatgcaggttcacttgccaatgtctttataaaacaagcatcagcattgaaacctgctcttccacacaatccttttcctaagtgtataactcttaggtatttaaaaaattcttccatagtctcctgatctgcagaacccacctcacctgcaagtttaacatttttcacactgtatcaccttttgaaatgtgtaggctgctagcactagccaagaagagtttaacgttttcctgaccctgcataccatggtcatacatttctctaaatttcagcctcacatattgctctccactgtactttgtaaagtcagtcatcatctcatgaacccacaaacgtagccaactttccatttttcccataacatcatcacatactatagatgttactgtagcaccttctggcatggcctcctgtgcagatgggcacattggctctcctttctgcatgtgttgtgttgttgatgcatcaacgctgaactcatggccagcaccataaggcacatcacccatggccctgctgggcttcggagcacagacagcacgtcagcattgtgcttgggactattttaaacagccatatcactacaaaaacacaccaaaacgtgaaaagcatggcacaaaataggccaggaggaagactctcgcttacggcatgagctggaacaggaaggcagagcgttgccctttcaacttcagtgaggaatgtgcttatcccgcaactggcactcttcattgctctgcacatgttctccagtgaccacgaaaatgccatgagtagtgacttgggtgttataaataaatttgcacatacaggccaggcacggtggctcacgcctgtaatcccagcactttgggaggctgaggcgggaggatcacctgaggtcgggagtttgagaccagcctggccaacatggcaaaaccccatctctactaaaaacacaaaaattagctgggcatcgtggcatgcctgtaatcccagcgaccctggaagctgaggcacgagaatcactagaacccaggaggaagaggttgcagtgagccaagatcgtgccattgcactccagtctgggtgagagagcaagactccatctcaaaaataataataataataataataataataataataatgcacatatggaatccacaagtaatgagggttgactgcattatgtgaaataagcacatgcccaatttttacttcactctgaaaaagcagagtcaagaaagctggttcacaaagaatttgagaaactgggtctgcatggtgagactaggaatgctaatggaaggttgctaaaaaccaccagaaggcaaggaagctgtaaccttggggttatctcacctcaaagggacaaagcaaagatagcaacagagacttcttaagctgaacacattcctcacgggaagctccgttaagcctccacaatggctttcaaagacagtgccctgaacttacaaacagccaggtcctcttaccaaaagctacatgacaaaacgatcagcctgagttgcatatgccatggccaaggactccctgctgggaaacgtcactgtttctcacacagatttagagacatctaaacaagttctggttgattgcatgaagaggacaccatgaaagtggttaatgccgttctagaaacaaagcaaatgagtttcaatcctatggctctgtgaaaagagtctctgatttcaggactataaatacattttctcaatgaataaacttcatggtcccatttcttggtgttttgaccctgatttacattgtgcacacaaataaaaattggatttttatatttcctttctcctcttttaaaaacataagattttgatttaaaactgtttcagttacaattgataaaattcagctaaaatcagattaagcaacaggaacttattggctcatgaggggaaaaataagggtgtagataccctcaggcatgactggtttctcttcttgtttttaataacctttttatttcagactagattcagatttggaaaaaagttgcaaagatcatacagaaagttcccatctacactgcacctggtttctcttattagcatagtagttagtatgacttatcacagttaataagctgatattgacacagtgtgattagcaaaagcccacactttactcagatttccctgtctttacctaatgtcccttttctgtctcaggatcctatgcaggattccacgtcacctttacttgtcaggcctccttagctcctggtggctgtggcagttccctttgtttcctggttttgatgacctggacagttttgaggagggctggtcgaacatttcgtagcgtatccctcgattgagactgtcggatatttttctcatgattggactagggctgtgtgtttgggggaagaagactacagaaacagtgccatttcctcaccccttgattgcttggctgaggttgccaggtttctccaccgtaaagttactttttttttttttaaaggtgtgcaaattaaatgagtggtttctcatagtcaaacaaccggtttctcatagccaaacaaccggtttctcatagccaaacaaccggtttctcatagtcaaacaaccggtttctcatagtcaaacaaccggtttctcatagtcaaacaaccggtttctcatagccaaacaaccggtttctcatagtcaaacaaccggtttctcatagtcaaacaaccggtttctcatagtcaaacaaccggtttctaatagtcaaacaaccggtttctcatagtcaaacaaccggtttctcatagccaaacaaccggtttctcatagccaaacaaccggtttctcatagtcaaacaactggtttctcatagtcaaacaaccggtttctcatagccaaacaaccggtttctcatagccaaacaaccggtttctcatagtcaaacaaccggtttctcatagtcaaacaaccggtttctcatagtcaaacaaccggtttctcatagtcaaacaaacggtttctcatagtcaaacaaccggtttctcatagtcaaacaaccggtttctcatagtcaaacaaacggtttctcatagtcaaacaaccggtttctaatagtcaaacactttcctctgggctggcttcattctcatgctctcagtggcaaagagagctcctagtagaaaactcaatgagaaaagtgaagaacatttttgtgatacatgtttaaaactgtcctggggatggtgtcgttggcctggctggggtgacatgctcatccatgaccagtcccagggcccaggggtggaaccccctgggtgaggtgaggtcactgctcactggtgatgaggagagtgggcggcaccacaagagccctggactgagacgaggcgggtgattccccacgggaaaccaggggctgtcctgaagggaaggaagggggcataggaggcagatgagtggacgtccaccccaggcattgtcatgggaaagcttgccaaacacacgcattgagcaaggtggaaggatccaggttttgggaatggagcagaccggagaaaagggatgcaaaatatcaaaatacagatctttcaagtgcgggagtctcagaagaactgcagagtgtttcatgtgacatcactgtgccttttaaaaatgtgaatcgaaatgcctttaaatggtcatgtgcttcccacatggccctgaagtcactgtgtgccacgggatgacagtgggctgctcgtgagacctccacctgcccggctcccagcaggggtgtttgcgaccccttctccagcaagggggagcgcctgagctttgttactgggagatgcagatggctttgccttcactgcagctctctgagaccacagtcagatccatgaaggattttgatcagcaaacgggtcaggtaaatggggtctgaagctcctctgtgaagggatgaccactatgatacctgcaaccccatcactgtcccttgtcctgacctctctgtactgaaacagtccacatggcccttgggtctggaagggctcaacccatcaagggctcaacccatcctggcaaggaaacaggtgagttgaactaaattgaatatgtatcgggcacttccttccttgagggctgggctcaggttttatgcaacttctgcggtctcccaactcatcaccctggcttcacacaggccccagtaattgacgctgcctggtgcagatcacagcaggttggtggcactacatggtcctgaaacagacacaggcacttacggctggggtctgtgatcaatccagcattttggatcagcagggacaactgcttatcaatttagaaaaaagcaaattagaacacgacctcatatttcagatatatatatgtgtgtgtatatatatatatgtgtgtatatatatatgtgtgtgtgtgtgtgtgtgtatatatatatatatatatatatatatatggaagactttgcaaacatgaaatcaaaggacagaacccattacaaaatggacaggaccatacaaaatataatttttatgtattgaagagcaccataagcaaattgaagctaccacttaggatctctaagaggtctttatacagtcagaaaatgagctctctcatacacaaatatcttccagagcttgtatgatttctcaatttgaaaggtaacagttctttttgtggttttaattttttctgattactatcgcatgatcataagtaatccctttgaaccctcttcacccatttggcagtagatcgcctcacctcacactggcgtagagaccttggcagacacggcggggtgatggtgcagtcatagcgtggagtgccacacagtctcagccactggaaagaaggggactgatttataactggaaaggatttccatgttgtattgttatgcaaaaatagcagagtgcacacaaaaatatgtcatacgatcttccataaaacaaagtacacagcccttatgtgaactctcatgccaataatccagtattcatggatctctgtgtgaccctggggtagggagggggtggcacaacacaccccagacagagttcatggccaacgtgaggggaagagcggtggagggagtggagggcgaaggctttgaagagaggagaaaggtgattttcatgatagataaaaccctgtgtatattcaagtgaaatttttaaaacttgaagagactgagaattgtagatgtttgaaaggcaagtcaccaaaatattaatgatggttaccattggacatcggcattttgattcgtgatttttctttttctctagggtatttataggtatataatcagcatgttttattgaactgaagataaggttacctagggtttgcaaatgtttaacaaggacaggtaattttgcacactaacaaagaaaatacacattttttagaggacaatttagaaatgtgcttccaaacataaaatatgtgcatgtccttagtaagcaattcaacctgtttatagctttattaaaacagtaaaaataaatagaaaataatacatatattcagcaaatggggattgattaaattatgacattttaaaaacactattaagctttcaaacacattatttttagttatatttctaacattttttaagatggcaacttttgtttagaaaccaaataacaaaattgaattaaaaaacccaaagtggaatcccaatacagaaaacagctaaaagtggagctacactggctgggctgcggtgaggcccagagccctgttatcctgcctccctctgtggcagcccctaaggagcaaaacatgaaagcaactgaccaagatgagtgtttattggcaggatctatcatgtagaatgaagataataaacattattatgctctttttgtaggaaatactcatatattgagtatttttactttaacaaggataaaagtatatgtacaagaaaattagcagtggttattcctatggccatttaaaaatgttagaagtttgtattttctacaatgaatattaaatgatttttgtatgaatttttttttttttttgagatggagtctcgctctgtcacccaggctggagtgcagtggcgccatctcggctcactgcaagctccgcctcctggattcacaccattctcctgcctcagcctcccgagtagctgggactacaggctcccgccaccacgcccagctaattttttgtatttttagtagagacagggtttcactgtgttagccaggatggtctcgatctcctgaccttgtgatccacccgccttggcctcccaaagtgctgggattacaggcatgagccactgcgtccggccttttgtatgaatttttaagtcccctaaaacccttttctttttttctttttttttctttttttttttttgagacagagtcttgctctgttgcccaggctaaagtgcagtggtgtaatcttggctcactgcaacctctgcctcccaggttcaagcaattttcttagcctccaaagtagctgggactacaggcatgcgtcaccacacccagctaatttttctatttttagtagagggggtttcaccatgttggccaggctggtctcgaactcctgacctcaagtgatccacctgctttggcctccaaaagtgctgggattacaggtgtaagccaccgtgcccaaccctaaaacccttttccttgttaaaagtttacattgtgatatggtttggctgtgtccccacccaaattttatcttgaactgtagttcccataatccccacataccatgagagggacctggtgggaggtaattgaatgacaggggtgattaccctcatgctgttttcatgatactgagtgagttctcattagacctgatggttttatacggggcttttcctcctttactctgctctgcacttctccttgctgctgccatgtgaagaaggatgtgtttgcttccccttctgccatgattgtgtttcctgaggcctcctgagccctgtggaacagtaagtcaattaaaccactttcctttataaattacccagtctcaagtatgtctttattagcagtgtgagaatggactgatacaccttcccaactaaaatagatgccttgctttaggggccctcatatccttgggaaacttgtactactcaccggtttatcatctttgaacatatcagcaagcattgtataagggtgccttcctaaccagcacataaccgctgaacagcaggagccttacgatgtattcagagagagagacagagagaagaaatcggtgctaccttgtgttaccaagtgctaggtgagtatcattgacctgcattaaggaacatttctcttgaacctctgttgacttagatctgaacacataccagaagcataataaaataaacatgaagctggggaaatcctttgtttctggctctttcacattcacaacacaattctatacattgaatgagaacagaaactgttcctgggaacagatccgagcaaccctgtcacggagtaggaaggtgggacagagtggaggtgggcacaatgaagacagtgtaatcaggatgccaccacagggccaacatagcttcacacacgggcctggatctgggccagagtggaacacagcccaccagagaggatcgcagcccaccagagaggaacacagccctgcagagaggaaagcagcccaccaaggaggaacgcagcccaccagagaggaacacagcccagcggagaggaacacagcccaccacattggactgcagcccaccagagaagagcacagcccaccctcagtccctgtgggacctgtccttgctttctctgacttgccataggagcagcccatcaggctctaagaaggccccaggctcccgtgagaattcgaattctgcaggaggacatcgaggcagcaggcagtgaagcggtgaggggtgtgggctgagtgccgagtggacgcactcccaccagcaaggcccaagcagcggtggagacacacagtgtgactggctgggctctttagtgttcagaaaccaaaatgccagtgttagatttaatagtaaaaataaaaaaaacaaacaacttttaaagtaagatcaggttcaattctaactttaatttatttctaaatatcagcttcggttttggaagagtttgcatgaagtgtcacatggtgggccatggcctcacccttggaagaaaagggaagtcagtagtgaaggtcatagggggagtgacctggaggtctcttgagcctgaatcaccagtggagacatccgtgtcactgctggaaggacaggaggtgggggctcaaaataaaggggttgaaagctcaaaataaggatttcagaggcaattcagttcttcatgggaaagggtgtggtcctgggagtgcgtgggcatggtgggatgggagacaggtcattggaggtcacgaaagggagaggggtggaaaggagggccacgtggatgtgaaggcaccaagggtggggcaggccaccggtgccaaagccagcgtggctgcggggagggttggaggtgggaataggagggcatggtacccagtgcacttccctcacagagaagggtggtggggataggacagaacttctctcctcccaagttcaacaattggattagatgtgcatttaatgcagattctcaaaatgacaaaatagtcactttattttcaagcaaatagggtattttatttcattaacctgatacctgcctcttccctgatgccactatctcccctaagcctttgagtggcagctgtttttccatcatgctccagctgcctcagaggtggtaactacaatttctccaacccacctcctccaaaaacgtttaattttcaaaatcaatttagatgcgtttccaagcctctgtccccagaaggtggtagaaacttccatctgccattttggccacccctattctcttgtgaccacaccccaccacaccccagagtcacacaaaggatccctgagtcaacaactagacaaccagatgcaacacacacacacacacacaagtgcgtgcacacacgtgtacccatgcgtgagcactcacacacacacacgcacatacacacacacacctgtgcatgagcactcacatacacatgcacgcacacatgtacccatgcatgagcacgcacacatgcacacacacatatgcacacccacacatgtacctgtgcatgaacgcacacacacacttacccgtgcatgagcacgcacacgtggatgttgtgtcaccgtccacactccccgctggtcccaccaataggactaaagccctcatccttctggctggccgctgccagtgccgtcagctgaaggctcccggctaagtctcttccggtctcatgggtcgctgcctgacccatgccccattcctggtagcagttgccatgattggtcaaggtagagcatgaagttagggaacagcccagagaccaccctcactgctgacacccactgcaagtttggggagctctaagaccatctttaagtttgataatttgctaggaggactggcagaacttcctgtgagcggctctagtcttggttatggttattagagtgaagggattcaaatgaagatcagccaagaaaggaggtgcgtggggcagggcccgagagagctccaagcgtggaactgttgccgcctctccccgtggagctgtgtgcatggcacctgcttccccagcagcagcctggggcgaccccaaggggtgttgctagccagggaagcgcatggagttggggtctggggtcttggttggagctttgtcgcacagacccgactgactctacgtgttgctggccttccgtctccagcaccccagaagtcaggcggatgccatgtgagccaaggtccccctataaatcacattgttagcatacaccatctggcctggcccaaggccccagggaaagaaaggtattctaccaggtgggacaatccaagggcttatgcatcccagaggcaaaggccagccctccctttgggtaaggtgaaattctttactgcagtgggcgtacgtagaagggtctgcctccatacaccagccccaaatcaggccaattctgccgggccatctgggacccagagcaccctgtggcatcagtggacactctgtgggggcctcctagcagctccccggcccctgatgctcagcccacttccttttctctcctatacatgttgatgccaagtgcataccccaaatgcccacatcctcttctccaccccagggtctgttcccaggagccccaacctgggcacccagtgcacacacaccctaaagaaactccaggcctaagaaagcagctaagagtcttccttgcatacaagaatgttccttcacttggcagtagtgaaaaactggaaaaatctgtcaatagggaaatggataaataaattgtgagatagtcatacctaccacagagcacttcatagtatcaaaatgaatgaagtactctgtgtctgataacatgactgagctttaaacttaatgttgagagagaaacaaacaaatcacggaaagttagtctcgttgtactatttacataaattattagggcacaaaactatatgttaacagaacatacatatttatgaaaactgaagcaaatatggcataatattaacatttattaactgtgggtagctaaaatccctcacgggtatctgatgcttgttttactatttttatcattattattactacagattgtttatcattcgtgtttttggcttaaggtcaaagcgtgagaggcggctctgccaccgtccgtatttcttgccctctgagagactcacatttctccattggcttctgctgagctctgcccctctcttgggctgtgggattctttgatgaaccctggggccttggtttctctagggcaccactcagacagctcctagggagcagccacaggcggtcttgttgcctgaggcccctgacccaatctggtctggaatttctgggcaaggagtggccgaccctcctgtgtatgggtgcagcatggcaccagccactggcgcatggggtgcagcggggattggggcacatgggctgtgcgggggtgcaggtgaggtaggaggatggggagtgggggtggcgctcaaagacggttttttgtttgtttgtttgtttttgttttgttttgtttgagacagggtttctctcggtcacccaggctagagtgcagtgccttcatcttggctcactgcaacctccgccttctggcttcaagtgattctcctgcctcagcctcccaagtagctgggactacaggtgtgtgccaccatgcctggctaatttttatatttttagtagaaacggggttccactattttgaccaggctagtcctgaactccttatctcgtgatctgcctgccttgacctcccaaagtgctgagattacaggcatgagccaccgcgcctagccgagactatttttttttagctttctcctccaaaacatacctccagctgagaaggttggattgacattgtgcttagttcaaagaagaaacagctcaaggaattccacggttaatcatggagtacgtattgaaagatatgcttagaataacaagcgcaaggagtgggcttaagttacaacctgaagactggcgttggtgttaagggacacttttatttgtttttctgtgaaatttctctaattttttcctagttaaaaaattgagtcatgagtctttctttgtgtcagttcgtagactccatcacagcatacagaggaagaaaatcttcaagccaagctgttcagcctcagtccaaaatcatattctacttacagatccggggacaaaaatgccaattctaccattcatgatagttctgaatttgagcccaccttctcgagggctcagttgacagatgttttatctgggtccaaagacattgaagctgaccgtcagctctgccagggaaatgagagagagaaactgtggctcctgccccgacagtctggggtcccaagtctgcaaagtttacccacctgtacaaggtccgccaagtccacaccaggcggacagcagtgctttcaaggctttatttggggaggggtctgagggatgatgccatctccccaagttcagtgtggagccacttccttctttgcatcattattccttagttttctgccccttcctttgggaacatcttcttcctgcaaacacagtctagctcttactcattcttaccaagcccgtggcatttggcattgcaagtagtgtctggacaacatcagagctatagatatgcacacattttacttttattatttatttatttattcactttttttgagatgaagtctcactctgtcacccaggctggagtgcaatggcacgatctcggctcactgcaacctccgcctcccaggttcaagtgattctcctgcctcagcctcccaaatagctgcgattataggcatgcatctccacgcccagctaatgttttgtatttttagtagagacagggtttcactatgttagccaggctagtttcgaacttctgacctcaaatgatctgccctcggcttctcaaagtgctgggattataggcgtgagccaccgtgcccggccacattttaaagttagcccttcattctggagcaagctgggtgggtctcgagcaggaggctataatttaataacataatataatatattatattataacatgtataatataatactataattcctgttaaagaggaatgattccaatgacaatctacttgtctagaaggaaatgtcacgtaggacatgagtagtgatttacagacattgaagtggacagggaagcgtctcattctcaagaaagccaggctaactttgtgaatgaatgcacgtctcaggttttaccttcacagcagtcacatattacctccttcacccactccaggacaagaacaggcagcacacagtttacactgctgtgcatcttgtttttctttttacgtaatagattgtgacactctttccgcatcagtacataagaatttcatctttggccgggcgcggtggctcacgcctgtaatcccagcactttgggaggccgaggcgggcggatcacgaggtcaggagatcgagaccatcctggctaatgcagtaaaacctcgtctctactgaaaatacgaaaaaattagctgggcgtggtggcgggcgcctgtagtcccagctactcagcaagctgaggcaggagaatggcgtgaacccgggaggcggagcttgcagtgagccgagatcgcgccactgcactccagcctgggcaacagagcgagactccatctccaaaaaaaaaaaaaaaaaaaagaatttcatctttgtgctgagtatgttgggggtggggatcagtggagtattctgtcctattagtttatccattctgttgttgaatattgtttctatccattatattgtttctaatcgtttgtagttacaaccagcaacacaataaataatctacatctctcagatgtaacattcttaggtcaaagagtatgatttatcactgtaataagtgttgccggctcgtcctccaagagctgcatacttggacaatcatacaatagtccagcaggtagagtgctgctttctctactttagccaatggaccaggtatgagacttaaaagagttgtggccaggcacggtggctcacgcctgtaatcccagtattttaggaggccaaggcgggcggatcacctgaggtcaggagtttgaaaccagcctggccaacatggtgaaaccccgtctctactaaaatatgaaaattagccgggtgtgatggcatgcacctgtaatcccagctactcaggaggctgaggcacgagaatcacttgaacccaggaagcggaggttgcagtgagccgaaatcgcgccactgcactccaacctgggtgacagagtgagactctgtctcaaaataataataataataataataataataataataaataaaataaaagttgttgaactttcaaatctctgtcaaattgagtggtagaaaataaaatctcaaaatagttttatttgcatttcttgttataaatcaagttgaacaccttttcaatcttaagtgcctttccattttccttttcggtgaatttttcttattcttttctcatttttccattgagttatagatctttgtatcaacttgtggtctctgtatgtattagaaaaattaaccctttgcctggggtattactagcaagtgtttttctcacttaatcttctgactatatgtaaagaaacaaatttctgcacggcaaaagcaccacacaccctcacatttattaatctttaattttgtgccttctgggttttatgtttcatgttatagctccaggctataaatctctcactgattcttttagcactcaagggttatatttttgcatttaggttttaagtccatttggaatttatcctagaatcaggtatgatctacaaatccaatgtaactgttttacagatgcctaccgcttgccctctgtggttgctttaaaatatcgccacttgggccaggcgcggtggctcacatttgttatcccagctccttgggaagctgaggagggagaattgcttgaacccgggaggcggaagctgcagtgagccgagatcacgtcactgcactccagcctgggcgacagagcaagactctgtcccctgctgccaccctaaaaataaaatcgccaaatggagcacagaggatgttttagggcagtgaaaccactctgtatgctgtagtgataggtacatgtcattatacttttgtttaaatccataagatgtacaaaactaaaagggaacctgaatgtatactggactctgggtggcaatgatgtgtcaccgtagattaatcagttgtagcaaatgtaccctctggtgtggatgttgataatcggggagaccatgcagggcatacatgggaaacctctgtgcattcctttaaattttgctatgaatctaaaactgcccttaaaaaagattttaaaaaatagtgtaaactacaacattaataattttatattgactacatattgaaacagcaatattttgaatatttttgattaaacaaaatatgttgtcaaaattaaaaatatattgccacgtattatttgatattccctccttcacaaggtagaggctgattcattaagtctgtaggtcagacttcatgactcactaacgaacagaatgtgacagaagtgatgatgtgtgacttctgagaacaggtcatgcaagggattggatctctcttggatcattgctctaggggaagccagccaccatgttgggaggacactcaagcagcctggtggaggagtcccatggtgaggaactgaggccttctgtcaacaaccagccatgaactcagcatatgtgttaagtgagcatcttggaagcagatcctgcagccccagtcgtcagacagctgaagccccagccaagagcttggctgaacctcatgagagaccttgagtcagagtcaccgacctaagtcactggtaaatttctgacccacagaaactgtgtacaataatacatgtttattgtggctgcaagacactaaatttgggatgacttcttatgcagcaatagataactaatacatttcacaaaaaccatttattgaacaattcattttcctactaatttgagatgctacttttgctatacgaaattgctctttgaatttggatctttgctggattttctgctaagttccatctagttccatctatctactccattgttctgattgagacgtaaaagctttattttatgttttaatgtctggtatggtaaattctgcctaccttccttcattgatctaatctcaaaaattatgtcaccgtgattattagaattatactgtttcttcaacttttaagttctggggtacgtgtacaggatgtgcaggtttgttacataggtaaacatgtgctatggtggtttgctgcacagaccaacccatcacctaggttttaagcccagtgacctttagctattctttctgatgctctttctcctcccactctcctgacaggccccagtgtgtggtgtttccttccctgtgtccatgtgttctcattgttcagctcccacttataagtgagaacatgaggtatttgattttctgttgcctgcgttagtttgctgaggataatggcttccagttccatccatgtccctgcaaagaacataatcttgctccttttaatgactgcatagtattccatggtgtatatgtacacattttctgtatccagtctatcattgatgggcatttgggttgattccatgtctttgctattgtgaatagtgctgcagtgaacatatgcatgcatgtatatttataacagaatgatttatattttggggggtatatacccagtaatgggattgctgggtcaaatggtacttctgcttctagatctttgtggttaccttaaatttataaattaaattagagagatgaaatcttatgatgttgtagaccaggttccccaggaaacagactctgagatgaagatttgtctatggaatatttattaggttgtgctcctgggatcagcacctttgaagggcagaggcaagcaggactgggcagaaggaggggttgagttgtgatgaagcccagcagagacctcattaaaaactctgaagctggcatggtccttcatagacccactgaggcaggtgggcagagtctttgtacccatgcatcagacagtcattggagaggggctgccgtcagggagataactcatcttgggtgaggcatcccccttatgataggagcagtttctgaggcgggagtggcagccaacactcccagcagcttttgaaccaaatgccctggtccccagggtgcatctgggcaatgcgtgggcagatgtcgagtcttcctgcccaagaatacagtatgactttgcacttgaagtgtcttttgtatcccttgggactattttattttatttatttatttatttatttatttatttatttatttatttagaaatggagtctcactctgtcacccaggctggagtgtaatggtgcaatctcagctcactgcaacctccgtctcctgggttcaagcgattattatcctgcctcagccttccgagtagctgggattacaggcgtgagccaccatgcccagctaatttttgtatttttagtagagacggggtttcaccatgttggccaggctggttttgaactcctgacctcccgcgatctgcccgcctctgcctcccaaagtgctgggccttgagagtattttaaagcacttgttgtacggatcttaaacatttcctgttaggcttatttctaataactttaagttttgtgttattacgtagggtcatttcttccaactaattgtttattgtatttgatccatggaagctattgattgctacagtataactttgtactggctcttactgaattctcctattgtttgattttagatttggattgtggtcttagattttccagttatacaatcatctcacctacaaacaaaaatcagttttacatttctaatatgtgtctctttcataacaactttggctaatctcagtagaatacgagtatataattgcagtgatcatggtttccttgtcttcttcctatgttaatgggaacggaacattttacattaagcatggtgctgggttttgggttgagatagacttatgttgtcatggtaaagaaatatccttggagacttttaaacaaataaatctggagataggcttcattgctttttcagctttaccccgaatcatctcaaagataccataaacattttaaaccataaggatgcagggcttctgattaactgcagtaattctaccaatggtcctcatggaataacacaacacagacaggaagagtcagaatgctgggttctcattctgcactaccatccacaaccccactgtgggcaggtcacagccccatggctcagtttcttcctgcgagagtgagggaggagagaggtggcctccgccgctttaactgatgcctgcctagtgctgggcatcatgaaaacgatacttgttccctaaatgtatccaaaatatttatcctgatagctatgacagatatcttcacatgctgtgtaggaagtttaatgacttttgcaagcaattaaaaaaatgacaaatcctaattttggtgaaagaatgtgggatacaagaccattagcagtgatggacccttgaaggttatgtcgtttgtatttcatttctattccaatcgtgccactggccagcctggaggcaaagtgtactcccttgagcactgagatgaaaggcttctgggaagagagggggaggcatgagatcactcagcagatacgacctctggttttttactcagctcccaccactttccacatcccttccggggtctgagtatccccaagggtcccagagatgctggtggaaatttgtaaaaggacagacctgcgttttcatccatgatttattttgtttttacttactaataaatgtttgatacatgtgccagaatttggtgtgagccttgctgtcttcagcaccaggatgtgaggtgcggggagtggctggcactcagctgtctcaagcactatgagtcacactgagccccagcatcctttagacccggcatccctgagtccgagcatccttcagcaccaggatacattaatctagcatccctgagccctagcatttctgagtccaagcacccctgagccccagcatccctgagccctaacatccctgagccctagcatccctgagccccagcatccctgagccccagcatccctgagccccagcacccctgagccctaacatccctgagccctagcatccctgagccccagcatccctgagccctaacatccctgagccccagcatccctgagccctaacatccctgagccctagcatccctgagccctagcatccctgagccccagcatccctgagccccagcatccctgagccctagcatccctgagccccagcatccctgagccccagcatccctgagccctagcatccctgagccccagcatccctgagccccagcatccctgagccctagcatccctgagccccagcatccctgagccccagcatccctgagccctagcatccctgagccccagcacccctgagccccagcatccctgagttcaagcattcttgatccccagcatccctgaatccaagcaatcctgagtgcaagcatccctgagttctaacacccctgaaccctgccattactgaatccaagtattcctgaaactcagcatccttcagccgtagtccctctgagtttcagcacctgcgagccccagaatccatgagtccaagcattcctgagccccagaattccgttcaagcatccctgagtcccagcatccctaaatcccagtatcccagaatccaagcatccctgagccccaacatctctaagttaaagcatccctaagttaaagtatccctgagtccaaacatcccccgaatccctgcattcctgagctgcagcacctctgagccccagcatcccttagtacaagcatccctcagtcccagcatctgagtccaagcatccctgagttccagtactcttcaggccctgcatccctgaactcctgcatttctgagccccagtatccccaaactccaacatccctcagtcccagcatctctgaacccaagcatccaggagttcttcctttcaggattcagattcagagtctggagcaagtgcagcaatggcagagcctggtcacatgcctgcaccttgactgcaaggaagactggaatgggaacaggtgtatcttaggtttctgtggtagaaggcaggccatgccttggaagaggagaaaagagtctccagtggagtgagaggaagatgtggctgctcatgtccttgttctcagtagtgagaagggccagatcacactttcgaagtctgggtatgaagcacttccaatggatgaaacaatacactgttagcaatagcactttgaaggcccccagcctgcagctacaaagtccctccctgagccaggatgcaggactgtgctggctacgatagcacaacagcacgtccaggctgccctgcaggtctgtgacacctcagagccccacacaacaatcctcccagcacccagctgagcccacgcccacagggcagactgtttactgtgctcctactgtttccccagctgctccccagaagcttgctatttcctcagattgcaatgcagtttatcagattaaaacaacggccaaggggtttcctttcacctccttgctctagttggctgaaggaaaaaggactcagagactgaaaaacacccagagaccactgtccccacccaaagatcattctgactaagaggcctcaagccttttcccagaagcctcacgaagggcatcgtccccagatgtgctttttacctgtctcatgcctccctccctcttctccctctctcgctccatggaatttagaacactactgccagacgcactttcctaggacacgatttaatggcatactgatctttgtgatgtttctactcctaatacttaggaataagtgcatgtggggtccaacatgcagaactgtgtctccttccctgcggatgtgcatgcacctgcacacacacacacacgcacacacacatgcgtgttcatgcacaggcacagacacacacgcacacacacatgcacacagtgcatacacacacatgcatgtacacacacacacatgcgtgtatacacacacactcatacacacttggccagaggcataaaaatagtaagtaactgccgaagataccacagctggtcaatttaactggtgtctcacaaattgtaacaatatgaaaagtgtggctctttgggtagttttgctattggatagcataaggaagttacagggagaattttaatgtgtgcccctacgcatgatttctgagaaggcaacattcagaccctcggaacttttggccaaactcagcctttccacacctgctgcctgggttctccctgactacgggttgttaacaccctcccgggctcccaggcaactgtgtccatgtcagtgcatgtcagtgctctccagatctgtgttctgtctgtcccctcaaagtcggggactcctttcctaaggctgccctgacatacccttggggtcagaggagtagggaaagggctctctgatcagcctggtggagctgctctctggctcaatgtcttaataacaagaaaacctcctcaagttacagaaattcagcagaaattctaaattgttcctcaccctcactttattgtagcaaaagacccctcaaaattctgcacatttcacctggtttacatcaaatataatccacttggtgtagccctaagtgttttcattgaccccacagacacgcagtaagagctgagtgtgtgaagagcagtctctgatcttcatgcccaggcttggtacaaagtttctgacttccagggactggtcttgcagagcacagggcatgaaggcgtgctgcctgtgtctgccgtaacaagtcctcctgaaggcgttccacagccttacctgtgctaggaattacaattttacttaataaaaaacaagtgattggatgaattattaattgaatgagtgaatgatgcctgtcattatgctaaatattttacacaaaatatccatttacttccttacaaagcatctgagaaagaggccaatttgttcccattttattgattggacccagagtaattgtcgaagatgatgtggctggtcggtttaactggtgtcttaaaaattgtaacagaaatgaagtgtggctcttacggaagttttgctgtaggggcacagtatggtgagcccagtgggacagtcttctgcagaggcagacgaccccacccaaaacatgcttcaggtgacatcacacacagaagggcgaggaaagtttatgactcccgtaactgaggactctgggaagagctggccggcctctagctcgtgtaaaaaggcttggaagtagggacaagagactggcctgggtttcactgtggttaggaagtgtttgatgtagactttattattattcaggtcagaactaggaacggctgccattggaaagctggtgtgttactcacagatccctagaggaggggtccggccacgccatgggggccacctggggatgtgccagggttggtcgggatgctgaggggcagggaaagtgagaaggagcttctattgtggtttccacgataagggaggctgaggcagggtcagcaggcccaggactgcccagcttgaataattctagccctctggggacagcagttgccctgggtctggtccctgccctggggtaacaagtgtgggtggacagcggccgggagtgtgagcccacagaggaggtggcaggtgtgggctcctcctttgcacatggattgcagggtttgcacatggaaagcctgtgtggggtgggcgatggttcactatctgggaattggctgattgtgagaggagcagctccccagggtcagcagggccccagctatcagagtatcatatacagaaaatgagagacaattcatactgatggtgggctggggctagagttcctaatgggagagatttgtggggttttaatctcccactagtgccagaggagggaaacaccccccacccctggctttctcaacagctgcccagatgtggggtgaaggggaggagggagaaacatcaatgctgtcagcagctgaatatgaaagagtggggtcagactgctgctcaccacactgggggaaagagccaagtctcaggctgaatgctgaaggacctccccagttctggcaggaagcacggactcctggtctgcagaccccgagagatgtccggctgcccgtgcaccctcagccccttctgaccacctggcaggtgctgcctgcagctagctacatgctggttctgaggatctccaccagagcaggagagctggaggcatcctctagcaagccacgtgttttggatgcctgcatccacccctgaaagggacattaaaatgagggtgtccaggaagcacccaggcgttgggagtaagagcatctggaattatctttgtttccttgtggtaactgattgccatgtctattagttcatttttatgctgctataaagatactatctgagtctgggtaacgtataaacaaaagaagtttaattgactcacattctgcatggcaggggaggcctcaggaaacttacactcatggcagaaggggaagctaggaccttctttgtatggtgacaggagagagagcacaagaaaaactgccacttttaaaaccatcagatcttgtaagaactccttcaccagcatcagaaccgcatgagggaaaccactcccgtgatcgagtcacatcccaccaagtccctccttccacacgtggagattacaattcgaggtgagatttgggtggggacatagagccaaaccatatcaccatgctaatggcctggttggcacagggccgtgagtgaaggactctgtataacaggggccggtggctttcacgtgctgttaactatcactcacaataagaagtacattttcacatggcaaaccacaaaagcatgtgtacatataacggacaaagtttcatgaagcttactgtacgtgaagaattccattattttctattgtgatttattccaacttgtaaaaacacttagtcctcagtttctaaattgatttcaacaccttcagcatgaaaaaagctggactagaatactgtggatggctctgtatagagcacccttgacataagtgactcttacttagaaaaagaccccatcttacacttcgaaaggcatcgtgccagcagggatcagatgttcacctaatccatagagatggcacccaaccagataagggcatacataggcacactctttaccatgcatcctcaccagaggactcatgggctataaaagagcaagacctcaccagctcgacatgggcacctccacacaccccgtcttgctgtcacctgtgatcagcaccagccatctgccaatgaaggctgtgcccaaatcaaagactcttccttgaaagaggttgaggactgtcaggatcaggccaggacactctttgtccacacctctctcattgaattggttcattcatcctttttttcctatgcccttttctcttgatgttaaatgtcaccctgatgtgaaaactttaatctgtaacatttatatattgattaagtatgttgtcacatatggtttgcaatattgattgacctgtggtgtggcttgagcctgcatgcttgtgggtctgactactgagtaaacaggaagttctaaggacaactacctcctcgggaaccccatggaactcatggcttttgtgattgaaataacatcagtaaagtctgaccttgtggagacacacaagtgtgcgtggacctggttatgtctgacctcgcaccactcacaataggatgcaccgcatcagtgagtcagcttctgcaggctccagacgctcacatgggggatttgaaggtcctctagaaattcctgaattggagggtgtctgtgtatttttgtttttaaataattattactgttaatcctcctccccacccatatcaaagcaacagatgttaaccattgaatattaggaaaattttcaacaaggtaaaggagaaattaaattctgcaataatctcactacccagagaaatccactaagtccagtaaaggcatacttaatttcacttccttttctatcctttctctctcctctattcctccctccctccctttctttctaaaatggctatcattattaatcattatgctatgagcattttctcatattgttcttcagacatagaatttaaatagttgcatgtatcatttagatagaacgctatcacttattcatttcttattttgaggcatttaaatgatttctttataaataatattgagatgaacatcccattacataaacttttagtaatatcttccatgttcttaagatatattattagaagagaaaattactgggtcaaaccacagttattttaaattcccttggttttgtgaaatgggaaaataatacaaatgaaaaatacattgagttgggtttatgttctcagaaaataaattgtcaaaaacatctttatttaattgcactgcagtaggacagtgatgacatgggttatttttcttaataccatcaagatgggtagattttgtataggttttgaatatgttatctttatgaaacacgtttgcatcaaccagtaaaatttagaaattaccattatttttcataccgactcttagctccatgacacgtgaattatgttaaccatgttttaaaacttacgaagtaactaaaagacaaagggtccttaatgtacctaactaggagaatttatatttcctccttgggtttcagaagcttaaaaagtatcaacatggtataatggaattgcaaaatgtattatcttggaaacttttttttaaaacctcagtgttgttagcaatcactaaattgcatagatgcttcatcatttttgaaggacagttcgtatttctgatttttttataagtaaagatgcacccaaatggcttttgtctaccactcatattatcaaactgtctaacaaagattctggcagttcatcctcctacatgtatgaaactgccaagtcattatacactcactgccagtgttttttttcctaattgttaataacttaataggttataaaatggcatcttgatgtctccacctaattttctttggttactaataggtttgaattttatggggttttggccattgtattattttggcagatatctttaagctttttctctttcttacagacttgaaagagctctttatataagtatattcgctttttgttatatatgaaaaatatcttccccaatttgctaaaagtgattaccaaaattaaaacataataatcaatgctataaatgaggttgttaaatagacaataacatgacaactgtactgataaagtttggatctgtgttccagctcaaatctcatgttgaattttaatcaccagtgttggaggaggggcctggtgggaggtgattggatcagggaggtggatctctcttgaatgatttagcaccatctaccattgctactgtacagtgagtgagttctcatgagatgtggctctttaaaaggacgtggcacctccctcctctctctcttccccctgctctggccacgtaagacaaatctgcttcccctttgccttccactatgattgtcaatgtcctgaggcctccccaggagccaagcagaagccattatgctttccctacagccttcagaaccatgaggcaattggagttctcatgaatgatttagcaccatctaccattgctactgtacagtgagttctcatgagatccgattgtttaaaagtgtgtggcacctcccctctctctcttcctcctactctgcccatgtgaagtgctggctccccctttgcctttcgtcatgtttgtaagtttcctgaggcctctccagaagtggagtagatgtcagcatcatgcttcctgtatagcttgtggaacggtgagtcaattaaacctgtttgttctataaattacccagtctcaggtgtttctttatagcaatgtgagtatgaactaatacatctactacaaatccaaaagcaaacagtgaaatctcctttaattcgaccaatgaacaattactgctttcatctgttcaggttctattcaattcttgacctatgtggatatttaacatttatgtaattacagctaagcatattataacattttagtttaattcacttgaataacttgttataagtacattattttcacattgtttcatggttttcataatgtagtatctatatccaacttaagaatattttgatggtattgagaaatagaaaaacctattgcatcagccagagtccaaccaggagatagaaaacacatcggctttttttttttttaacagaataaagttaacataaagattatcgaccaggtactttagattttttaaaaggccaaagaaaggtatcacagttggggagggaaggagggaagtcactctaggcctgaagaaggagcactgtgggtctggaccccaaaccttgagtggggtgcactgcccagtgggtgccagtgactgtggttaggtgcaggaggatgctagatagagcagcagacaaatgccaaatggagtcagatgggacagctgctgctggcagagtaaagaggcattgctggaaggcactcacagggaacaggaagaatggggccatcttcctctgcctggcagagccttccagggagccagtggcaaagtgagtgtgtctgcagtcccagcatatcacagcaggtccagagagggatgacagcctgaaaacaagcacatcgatccaaggataaccagggctccctgcccccctggaaagtgtgtcaacagtagcagggcttgttttgcccttgcagaccatttactcaaaacagcctcttgggcctcagtcattcatgcctgcagcaaatattttttttttttagatggagccttgctctgtcaccaggctggagtgcaatggaatgatcttggctcactgcaacctgcacctcccaggttcaagcaattctcctgcctcagcctcccgagtagctgggattacaggtgcaccccaccacgcccagctaattttcatatttttagtagaggcagggtttcaccatgttggtcaggctggtcttgaaatcctgacctcatgatctgcctgcctcggcctcccaaagtgctgggattacaggtgtgagccaccgggcccagcctgcagcaaatatcttaataccttaatgtgcacatggtaattagttaatatcacctttcatttaaactgtgtttcacagtctcatttcattttcacacatgttcaagacaaaacaaaacaacaaatcatgacttactataaactctagtctgtatcatggactatccctggtcataccaggaaaactgacttactatttccatccaaatgttggaagtttgaaacataccaatctgttgatgttcaactatgttcagggcactaagtggaattcaattaaataagtatttattgagcccttactatgtgcacagaggtctctgtccaagcttcatttgcaaatagattcatttgacaaagatgagaagtggacatgcaaactactctaatgtaaagaaaaaggaaataaacttgtatttgaataaataaatggtgtcttcacaaatctgtggccttagtcaaaagctcttcacattctcacccaatcagatcaatccattctgcctctccacttatcaatcttatttatctataaaggtccagtaaaaacgttactatatcctgtgaacagtctagttttgaattcatagacataaaatcttagcacctgaaggatacgtagaggtctggcctcacccttagtgttactgctaagaaaagtgggtgcaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgaaccgagattgcgccactgcagtccgcagtctggcctgggcgacagagcgagaccccgtctcaaaaaaaaaaaaaaaaaaaaaaaaaagaaaagtgggtgcaattgatggacacctccgggatggccagagacaaggccaggaggagcccaggcaccctcccttctgggtaccactcctctggggcttgagctctccgtggctttgttgtacgtttaccccttgaccccctgctgagattataagctctatatggcaggaattgcgacttgggacttttgttccacctatgtggctttacatggagtaggacctcagtaaacatttttgcacagctttattgaagtataattggtgtatggtaaactgcacatacctaaagtgcacctttgatgagttttgatgtatatttatgcacctatgacatcatccccacaattaagacaatgagcatctccatcagtaaacattttttgttcattgttgtgggaagtcaggaaccccgaatggagggaccggctgaagccatgacagaagaacataaattgtgaagatttcatggacatttattagttccccaaattaataattttataatttcttatgcctgtctttattgcaatctctgaacataaattgtgaagatttcatggacacttatcacttccccaatcaatacccttgtgatttcctatgcctgtctttactttaatttcttaatcccgtcatcttcgtaagctgaggaggatgtatgtcacctcaggaccctgtgatgattgcgttaactgcacaaattgtttgtagagcatgtgtgtttgaacaatatgacatctgggcaccttgaaaaaagaacaggataacagcaatgttcagggaacaagagagacaaccttgaactctgaccgctggtgagccgggaagaacagagccatatttctcttctttcaaaagcaaatgggagaaataccgctgaattctttttctcagcaaggaacatccctaagaaagcgaatgcatccctgagggtgggcctctaaaacggcccccttgggtgcggctgtcttttatggtagagctgtagggatgaaataagccccagtctcccgtagcgctcccaggcttattaggataagtgaattcccacctaataaattttggtcagaccagttgtctgctctcaaaccctgtttcctgataagatgttatcaatgacaatggtgcccgaaacttcattagcaattttaatttcgccctggtcctgtggtcctgtgatctcaccctgcctccatttactttgtgatatcttattaccttgtgaagcatgtgatctctgtgacccacatcctattcgtacactccctcccctttggaaaatcactaataaaaacttgctgattttatggctcaaggggcaacacggaacctgccgacatgtgatgtctcccccggacacccagctttaaaatttctctcttttgtactctgtccctttatgtctcagaacagctgacacttagggaaaatagaaaagaacctacttgaaatatcatgggtgaatttcgtccagtagttcatggaatagacggcccacacatgacaatgatgaaatggtgcaagaagcccgatgtggcatctttagggagatccaagggctctggactcgtggaagctagggcattttgtgttctcacagttcgaagcacacgttttcaaatgtccttgctctgcctttgtcattccctcagtaggatgggcgtcttccagtctgaaacatcatcttagtcaccacactccaaagccctcaagtgaagcagagtagtttcacatcacacaccaattaagccacacattagttagaactagaggttgctgtgaggaccacccagcacatgttctatgaataatgtaatatatttctataaatcagtatataagcaaaaatctaaaatagttttttctattctataaacaaactaaagtatatattacgaaactcacagtgtgtacagtgtaatataatattcaaggaaaaatgttcatcagatcattcaataatttctaactcattattatttttagaaattactggtacggtcttatgtttgataagctctcatcaaactaaattttgctcatctctaagctacaattttataaaggaagctgtaccaaacccttccaatgacttctccattatctcactggtcattgggtgagtcctcaccatcacagaagggacctgtaccaaacgtttacaaagatctcactggtccttgggtgagtcctccccaccactgagaggacctgtaccaaacccttccaatgacttctccattatctcactggtccttgggtggtgagtcctccccaccacagagaggacctgtaccaaacccttccaacgacttctccattatctcactggtccttgggtgagtcctccccaccacagagaggacctgtaccaaacccttccagtgatttctccattatctcactggtccttgggtgagtcctccccaccacagagaggacctgtaccaaacccttccagtgatttctccattatctcactggtcattgggtgagtcctccccaccacagagagaacctgtaccaaacccttccaatgacttctccattatctcactggtccttgggtggtgagtcctccccaccacagagaggacttataccaaacccttccaatgacttctccattatcttactggtccttgggtgagtcctccccaccacagagaggacctgtaccaaacccttccaatgacttctccattatctcactggtccttgggtgagtcctccccaccacagagaggacctgtaccaaacccttccaatgacttctccatgatcttgctggtcatggagtctggcccatatccttactgcagcaggatggtgatgggtgggctgcccccacctcctggatgctagtgtttctcacaccacctgtgcttggagggcttgtgcttctgcccccacctacaacactgtcaccagccctgcccgctccattcttcccaccagccctgggcccctcctgagtgacatgcagatcctgcatctgtcacagctgccacctgagagtcattcaagccttggatccatcacagctgctacctcggtctacttagctcatgctgcaacatccagatgcactggtcccaagtcccagtaccaactccacaggagtgaggggtgctttctttacaagaggaaaatttggactcagacacacacacacagggagaaagccatgagagggtgaaggcagaggtcgggtgatgcatctacaaactaagagtgccacaagtggcttgacgaggtgccaggcagtctggtttgaggtgccagtggtttaggtttaattccacagcacctggggctgggcctacggacattcaatgcccatgccaggaggaagaggccactgccctgtttaggtgtaactcctgcttggagaaatgaggagaagccgcagctttctgctggatggtttccaggcagctcagactgagcccttgaggccattttcagatggttctcttcatttctggcaagtttgcagttgcagatgctattgagaaggcagaacccaaagagagaagagaaggcatgggaaggcattcagagcccatcacaacgcagctgagcagcagccagcatcctttaatggcaaacaacgcaaactgacttgggcatatcaggcatgaagacactgcaaggacgtagagaagtttgcagacttgagaggaaatctagaaaccaggtgagtaagggacaggctccagagacttctgggagtctgggtggcagaaccatgggtgggtttcccagggctctgatgcagctgggctccaactatttgggggtcatgttgttgtctctctgctagagctgcaaactgtgggaccgagcatcccattggcctagctggggccacatgccagccttggctgctgatgggaaaggattaggggtgagagctctgctgatggtgcttgatgagaaaaggataattacttcaaaggatgatctaggtcctcttaccaccgcaaaagagaatggcaaaaatgtccaatctacacctaccaatggtgagttctttagaagtctctgcatgatgtgcaccacagggatttggaagagggaaggatgcagctgacctgggggagtcacacggcctgtaagaacaaggaacttggtcaagcctgagagaaagtcgcatttgagtaggtggagaaggccgggtgaagagacataccggcaaaggctgcagcagggacgtgctgggcatgttctggggaaaaggaagaggggttgacctcagctgggagccatggtagaggccaggctccctgttctccagaggacccatgctgttgaccacgccttccttcctgaagttcgcttgttcattggctgctgtcacccatgatcttctgggtcttctcccacttttaccccgcgctttctcactctcctgaggctcttcctcctctccctgaccctcgaatgttgctgttcatatgttcacatctaatcactaatttgatggtgttaggaggtcataagggctctgccctcctgaatggaattaatgccctcctgaaagaagcctcagagagctctcttgtgccctcatcccttctgccatgtgatgatacaacaagaaggcaccatgtatggaccagaaagcaggatcttaccagatgctaaatctgctggcaccacgatcttgggcttcacagcctccaggactgtgagaaatgaacttctgcctcttctaaaccactcagtccatggtattttacgatagcagcctgaacacactaagataagggccctcctgaagctccagctatttctcaggagaagccctccatgtcaaagtctccagctcagatctccatccatgcttcagagttgcccatgcctgttgatgccccccaggctggccagctaaactcaatacattcatgtgagctcatgtcccatccccagacatgtttctcacacctctttactgacttagtggatggtgtccccttcatctagtcattcaagccccaaacccagacatcccccttgtgccccacctttgactttcctcatgctccattatggactcaccaattaatctttttgttcttccccccagtctctctggaatcaccttcttcatccacacacactgcctctgccttggttttgtctgtcatcatctgcactctgggctgctgcaatggtctcctggcccagtcttagcctattcctggtaacttcctctagctgtggtcagcatgaggttcgtgaaacaaaagcgggcttccatcatgccctgcagagggctctcagagagtctcgtacctcagggcaatccagcccctttatcgtgatacccttgtgatcaggggcctgttcatggcttttcccattcactgcttgaatgtttagccccagatggttctccaaaagtgtccttcctttcatcttgtcacgtcttcacagtcctcctacctatgctggtaataccctttccagtgcttgtagttctcagttctcctggagaagtcagcacagacatagtttccttggggtaggctttcatctttcacatacaggtgcacacactctcacacacattcacatatgcactcacacacacatctcccttgggtctgcccagtaccctgtactcagatgcagagccattctccaatgtccataattgtctatttattgcctgtgtgcacgtgaaagcacagcaatgttttgttcatctttaatactcattgcctagcatgaggtgtgacataaagggctccaataaatattaattaaaataataatgaatgaacaatagatagtgcagaagaacatcttggaaatatgccctatcttgggtcatgttaccccaggagctttctatataagttgaaaattgattggaaataggaagaaaacttagataatttagtgtccatacctgcatgattatctgtgtcagctaatgcaatggtcagccctgatgtgcactcctgcaaggagccagtggaatgaggtgacggggaactgaatgagagccttcagtccaggtaattctgatcccttcgtttccctcttcaacctctaagaaagctcttattttcattcagttgtttgtatttcatgcccggggcccaaactcatttgttcagttctgttataatttgattattgcagaaggaaaaagcacacatattcagagacagacaagagtacattgttccactgaggatcacattttggctttaaaatatccaataacaagaatgccggtgcagtattgcctacaaagaacagctgagtttggaagactaaacattaatactcactgtcaaaagatgaccaagagtagctcccaagtgagttgggatgatgaaggagacctgatgcattgagtcctgtgcaagtcagtgagtccgtcagcagccaggacagggttccacattccatctgcagagaccaatctgggctgtggtgcaaagggactgctttagcattctttctttatgttcactcatactcacataaaataaaacaaaatattatttttaagaggctaaaactaatttttaagagggtttatgtttcagtcacctgccttaaatactatttcccctgaactattttaaggcttacacaaatatggattaataggggagaaaactgcccctgcaatattccctaccagcaagtgatggggtggggaacccctgaatccccagatgcatcacccactgaatggactcctccaagaaacagcaggccccaatcatgtaatgggtaaattatttcaaatctttgaagaacagagaactcttccccctttcaaactgttacagagaatagaaagagatgggaagtaagtattcattcatttttggaagcctaatattaatgctaaaatatgaccaagattttgaaacagaaatactatttttttttgtttttgttgttgttgtttttgagacggagtctcgctctgttgcccaggctggagtgcattggtgcaatctcatctcactgcaagctccacctcccgggttcatgccattctcctgcctcagcctcccgagtaactgggactacaggtgcccaccaccacacccggctaattttttgtatttttaggagagacggggtttcaccatgttagccaggatggtctcaatctcctgacctcatgatccacccgcctcagcctcccaaagtgctgggattacaggcgtgagccaccacgcccggccaacagaaatactgttaattaatcttgctaggtaatgaggagacagagccctgaatggaatacccagtactgcgttaaaaaacaacacaatatattagtctgcccaggctgtgtcttaccttaatctgtttttgttgctgtaacagaatactagagactggattatttatgaagaaacgatgtttattggccaggcatggtggctcacaccctgtaatcccaacactttgggaggccgaggtgggtggatcacctgaggttaggagtttgagaccagcctggccaacatggtgaaatcctgtctctactaaaaatacacacacacacacacaaaattagctgggcatggtggtgggtgcctataatcccagctacttgggaggctgaggcaggagaattgcttgaatccaggaggcagagcttccagtgagccaagattgtgccactgcactccaacctgggtgatggagcaagactctgtcaaaaaatgaaagaaggaaagaaagaaagaaagaaagaaagaaagaaagagaaagaaagaaaagaaaagaaagaaagaaaagaaaagaaaagaaagaaagaaagaaagaaagaaagaaagaaagaaagaaagaaagaaagaaaggaagaaaaagagaagaaaagaaaagaaaaaagaaaagaaaagaggtttatttagctcatgggtctggaggctgtgaagtccaggaacatggtgctgacatctggtgtggaccttcctgctatatcacatggcaaaaggataagagcatgacagctcagatctcttttcctctttatgaagccaccagtccaattacgggggccaccctgatgaccttatctaatcctagtacctcccaggccccacctccaaatgccatcaacatataaatctggggattaagtttccaacacatgagacttgggggacacatttaaaccacagcaggcggccagaacaaaataccacagatggaatggcttacacaacagagatttattttcctacagttctggaggcagaaagtccaagatcaaggtgccggcaaggttggtatctcctgaggcctctctgttttgcaaacagtcaccttctcacagtgttttcatatagtcattcctctgtgcatgtgcagcctggagttcttttcctctccttataaggacatcagtcctattgggtcaggccctcacccttatgacctcatttaaccttaatcatctaaaaggccctatctccaatacagtcacattgtaggttttaacttcaatctgtgaatttttgggggaacacacaccatgttaaagtgagatttattctaagaagagaaatgttattcaatattaagaaatatattactatcattattcatattaataagttaaacctactcatacattttattttaccgagtatacatacaatggtgtagcatacaatggaattatattttgtttttttcttcatgattttatgtatatatgaaatgtatacattttatatatcatacataatatatttttatatacatctattcttggtgtctttacttttactgatttcttacaacttcagacacacagacacatgcacactgacatatgtgcatgtcagtgtgcatatgtgcatacatggtagatacatacacacacacacccctttgctcaggaaatcaaactcaatttttctgagattcatctactttgcttgaagtactaatgactaatacaaggaacttaaaaataggcagagagtgcctctagaaaaaccctcttgtaattaagggcagcaagctaagatataaaggaaacacacagtctccctctctctctctctctctctctctctctctctctctctctatatatatatatatatatatatatatacatatacacacacacatgtatgtatgtatatatacacacacatacatacgtatgtatgtatatacacacacacacacatacgtatgtatgtatatacacacacacacatacatacgtatgtatgtatatacacacacacacatacatacgtatgtatgtatatacacacacacacatacatacgtatgtatgtatatacacacacacatacatacgtatgtatgtatatatacacacacacacatacatacgtatgtatgtatatatacacacacacacatacatacgtatgtatgtatatatacacacacacacatacatacgtatgtatgtatatatacacacacacatacatacgtatgtatgtatatatacatacacacacatacatacgtatgtatgtatatatacatacacacacatacatacgtatatacatacatatatacgtatatacatacgtatatacgtatatacatatgtatatacgtatatacatacacatacatatatacatacacatacatacatgtacacatatgtatagattgataaatacggatatctatccctctatatatctatatctataattcaaagtgatcattacaatgttgactgtctctctctcagttctgttataatttgattattgcagaaggaaaaagcacacacatctagagatagacaagagtacattgttcccctgaggagcatattttggctttaaaatctccaataacaataacagtcatgaaatattgtgctgcctgagagtcatcattgtaatgatcactttgaattattttttgttctacatttacaagagtaagattactatttcaaattatttgaatattttgtgggcttttatataataaatagtctgtcccaaaattatattggtatatactactaatagtcatacataagcgtgccaatttcattgcaattccaccaaattttggtagtataatttttatttgtgcaacataacaggtatgaaactacattttatagttaaaatataggtaactatgtcctatattttaattttcaccatctgaattactagactttctatcattttccttgcattaattcacaatttgtctaggataacccagggtccccttccttttattctaccaacttttgtccctcaatacaggatacctggagcaagattttacttctgtttggtttctgctggaaaacctagtttggaactgaagaacttcagtcttaaaacatcagctgtttgcctgacctgttaaggagactattctcacctttaacttatcttggaaatctcccgcctttgttgggttcttttattgagttcatctatctaacctattcctaactccccctcccttggctcccaggccacagaatctcagagttggaagcagccataagagccacattctccagactctcagcccaagcagccatccccattgtgtgcccatggacttagtcaaccagcattggtgcaaatgaccaagatctcaaagttaagattagtcaaaaatggctttctagccattctctatgcatggaactccagtctgcttgtgtctctaggcaccctcttccttgtggacttaggatctcccattttaatgagacttcttatataaataacatttctaaagtatcagtgaagctttcaaccactaggttatcatagatatgtcctatcttccctcaaagtggctgtctctagtccattgtaataatttgtaataaataaatgtaatgggatcatctattggatagaagaactttctattgtggagatgaattattaatgcagaaatccacaagcttctaaaacctagcactggcttgggcaaaggtattgtctctatgtgaacacctttaaaaatagaaaagaaatcagtcagtgcctctcaaattgattaatgtatactaatacccattcctccagaatttatgatagtgactctgttatatgggaaaagtattactatcccataagatactgaaatgaacacctacatttatatcaaacacacttgaaataaactgctcagtagcacatcagggctgcacaggtcaatgctgcctgcggtgaggttagaccagcttccctcccaatggtggaacacatcacagatgtcaagggagaggcaggaactcaggggaagaagacctgatccagacagctcccatgtgctacagactttttcatcacatcccgcacaactcatgtccttgtctcatctttatgacctatgatgacacctgggccatatcccacaaacacaaaacactcctgactcagaagctgacggccagtgtttactcaagtggcaagaaaggctttgtgttgaaaaatcgcagaaggaagccatctccttggaggctcatgcatcgccttaacaagaagagtgttgttcatatacattttcttgatcagcccaggatcctctaatgttttttgaatgtctaacatgtaccagttcaaaggaaaaacttctagcttcagagagaaagatcagaaagaattcagaagttttctctgaaaacaggattctcagtgtcctcaccttttcaatgtcatacaacttcagacacacagacacatgcacatatgcacacacagatacacacacacacacacacacatctttgctcagaaaaatcgaactcagtttatttgagatccatctactttgcttgaactactaatgactaatgcaaggaactcagaataggcagacagtacctctagcaaagccctcttgtaatgaaagggcagcattctaagacatacatgaaacaacacagtctaactatctagtcattctctgtatgaagaacactgaccacatgttaaaactgttcctatccattcctgttcttcttggttattcaaataactttggctttaagactttttttaagtgacttaacaacttattagcttattttcctgaggctaacatgctgagcttgcaaatacaattttaaaaggagcaataattgaatgattgaatagaatattcccttctgttttatatggattgcaaagtttttggtattgaatagtagattcaatagtaaaaattaaaaattcaatattcaaaaattatatttgaatattcaaaactatcaaatagtttttaatagttttgaatattcaaatataattttcttctgtgaattaactatataaagtgttttctcttttccaaaataatgacctggtattccatattcgcttcccttctgtgatgatttctgcagaagatgacagataatggccaaattcttaccaatgctggggaggaagatatgacccatggactggtctaccattagctgtcattgtgggtttttaaaaaattaactagagatgaggtcttgctatgttgccgaagctagtctagaactcctggctgaagcaatcttcccgccttggtcttccaaagcactgagattacaggcgggaggcacttccccagccattatcactgtggttttattttgcacttttataaaggtccatctttgagttctttgctttacagaacctctagtcagtgggttttttcccctctttaaaataatacagctctctattgtatcaactgaaagtttcttcagctctaaaactatgattctgtcactaaaatgtatttttctgtccacatactgacttactcaatctcaagttacaaactgtttaatttaacagttgtcaacaggtgtatcagctcagccctgtgactggttctgtaaaagattgtgcccaagttaaacatgggactcagctcctgttagtgaattcgagaacctggcaaactctttctcactgaagaactgtgcagtattgagcactgttttaatccgtgtaaatcttccttcctcggggcttttggcataattgaacacctgcacaaggattgtcagtcaagtcatgggatgtgtaggatgtaccatgtttttatttacatgttcctatttccacttgtgtgatcctgagcatagagaaattctaatccggcagactctggaggagggaaggagggcaggaatgtttactgtggagctgctgtgaaggcagcattgcacgtctgttgtttccactaatttcatcctcatcacagtgctgtgagccagcttctccttgtttgtgtaggaggaagctgaggttcacagaagtcaaataatgggcccaaggtcacccagctagtaagtagcacagccagaatgcaaacataggcccacatccctggcgcacgccttccacctccaccagagccaggagccgtgagtgaggccaggtgcagagattggcacctgctctcagcgtctgatacgaaggagaagttgacagatcatatccctccctagcgcctccttcaatgatgggtctccaatccccagttacctctatgttaacacaattccaaaaatgtgacaattccaagaaggaagttccagttcatctttagaatgacttcctcatctgtaaagtgataatcatacagcaatatgatgatgcaaatcatgataacctggctggtgtctctctgaagctcttgggggtgccgggcattgtcctggccaggttacctccaagccttataacaataaagacaaggaaacaaagactcagaggtgtacaagaccccatggcgagtaaatgacaaagccgggtgtatgagttacctactgctgtgcaagccaccccaacctgtgagggagagaacagcggacgtgttagctctcagcattcgccacccaagaatctggagtagcttggcgggtggtcctggctcagggtctctcatgaggctcctgactcctggttcagggtcagctcattcaactggctgaggctgagggcaagtctcaaataatcggcttctaacttccctctccaaggggatgcctcactgcctggccgctgtcttccctaccatacctggcaaggaaggatgggcacaggagagtggcctagaggccagccctgcccaatactggatctggcatccaccatctatgccttattttcttcattagaagctagtaagcaagtctgagtcacactccagggaggtggtgttacaccaggtgtgcgttccagggtacaggggtgattggagctcccaaggctcccgtcatacccggcaactgtaattctgtgataaaaggttccagtcattcccaaaaagcaccctccccgcagatgagacggaaagtttcatgtgtcaaatctcttgcaaagttattgacttactttttttctttaaagatactgactttttcatcaagaaactgaattttagataagtgaggatataagtgcagagccctctggggctaaacgttgcctgaaaagttttgaaaaatagatgagccccaggaatgtggaacacctttggtctcactctaacatagccctagaaaaactgcaaactggttctgtcatgtcggaattgctagacagtcaatggtttgcacccttccatttgaaaaaagtggccaatgtagacgctttgcggcagcatcagttctgaccaaaccatcatctgagcaaatgcgcattttcttcaggctcagccttcccgctggtgtccaccaaaggaaaatccgccctggccagtgagtccttgtgtcaggagctctggggcctgtgtttccctttgcctaaaagtaggggctggcagcacggaaggcctcctcatgagctttctggagtgttttctgagcgcagaggaaataagcgaggcaaaggtttggctaagggttcacacctgtcctcttctaatctctcacccactttcatcattgtgtatgtagtcgccatcgtcttccaaagttgctataataggggtcctgtttcattctttttattttgactacgttatctaacaattctttatacttgtctcaaaatactcattttttggtgggggtgatacaggaggggggcagggaagtgctgggttgtgaaaggcaggggtcctggtgagggctccaccttcaggcctatgcccacggacctaggtgaagacaggcactcctgttttcacacccaaatgttgcatttcccaagactaccctggcctgccacaccacccccccccatcctgtgcctataaaaaccctgagaccctcgcgggcacacacacagtggctggagtcgagggggaatcaccggcagaagaacacacacacacacacacacacgccgacgggccatcgatggtggaacaacacggacactgagggaactttggctgggggcagtcggaggagagcctggcctctgagtggcctgattccagggaaagaccaccttcccactccatcccccttctggctccccaggcatctgctgagagctatctccaccattcggtaaaaccttacactcattctccaagcccacgtgtgatccaatttttccagtacactaaggaaagaaccagggatacagaaagcctctgtccttgcgataagccagagggtctaactgagctgattaacacaagacacttgcagatggctaagctgaaagtcagactgtgacacgcccactggggcttagggagctgtaaacactcaaccctagatgctgccctgaggtcggagcccaggctccccacgacctgcccgtctgcatgcttcccctaggggtttgagctgcgggcaccgaagacgggagccatacacctgtcacacgccctgcgaggggaatatgggaacttatccagtttcaggaggagggaatgactagctaccaaacaaccaaagccaattttcctgtgaaagggacgctggggcatctgattacttttgttgctataaaggccttggaggctgggcacagtgtggtgtgcttatagcctgcacaacgtggcaggatcctgtctctctaaaaacaagagggggtgctttggtgaggatggaaaattctgaatagctctgccttgatgtcttctgctgtcattacagcaaaagtggtctggggtgtcactcaaacagaaaactgtcttgtttgggacttgagaagatttttggtgccttcaccaccagaaaatgaggaagaaggagcaaataagggaggaacgccaggcactgagggccgagggccttcacggcctgcactgttctgccgagcagggctgtgcgcagctgagttgagtcacgctgcctgcgtcctgggctgtgcgcagctgagttgaatcacgctgcccgcgtcctgggctgtttacagctgagttgagtcacgctgcctgcatcctgcacgcggccctgtgctctgcatgtttgaggtaggctgctttctccacacgcatggacatctttcctatggggtgaaggctaggcttacaagccctgtcttttggatgtggacatggatcccttgcacatgtgccttccgtggcatgaagactgtcagcacctggcaggactggagcgactagtgaaacaccagacaccagcccctcagccaaggtctcgcccagcacctccttccgaaccctgccctgccccggaggctgctggctccagtgcaggcctgactgtcacgggcacctacagcataaccctgccagtgacctcgcagcagctgcagcaccaagctctccaggcagcgccctggcgcaggtgaagcagcccaggcccgcgctgcaagggagccacactccagccggcgcattggcagagagagtgctctcccaggagaggatgaagcgctgcgtgggctcagggtttcaaaaagcccaccccaggttcactcccccgaaccttgccctgaagagctccccagactcggcggtgccagattcccagggatagattttgttactcagtgctaagcttctggactctttattttttcttttacagtggtctacagatatccccataacatccctttcttattaattaattcaaataaagataaataataaactgtgtggctcagtgtggttaaatgtgtatggcatttagaggttttgatgttgtcgtagacaaatgccgcttctctcccaaattgtttccacctccactccaggcctttcttcaccccatctcctcccagccccagacccactccttgcctgagctccagggtcgatcgccctgtagagcaagtctgcccgggatgaagctgacacacgaggctcatggctcagcccgcgtgtcctcacctgctgatgcagccccaggtggcctccccaggggtgcgagccacacattagcgtgagttcgttttgtatcagctgcaacctaaagagtttcaacccatgactcagaaggaaaatgctccgatagaccacacaacccaaacttgtaggagacttgcatctggatgtcattgtcattggtatagatgaaaggacacggccctgccattgagagtggcctcacatccccctgtaggctcccgggatgtcctgagctgcacttcctacttcaccctgtccaaggctggcccgtcgtcccccagcatccaggctcacgaaggacggcggtcccctgccccctaggagggagtcagctccttgcagccactggaagcccacccagcggctcacctggactcagccccagcccccagcccacatctcagctgggatttccccttcctgcttccgaggctaggaggaccctggaaaggactctcaccctcctgctgctgcatgttctgtgtctgctttcctctttccaagccttccgtggtccctgcccccttgaagggcatattccagtgagcaaaatggacattaaatagccaacattctctttctaaagcaccagctggcccagcaatactccccgcccccggcccccaaccccgaggtggccactgcaggtgttttcgtcacgtcccaatgaggagaattttaaccaggacatcagatggctcccagtggtcttagccactgtctggttttctctcttcctgcgcccacgctgatctggactgacctcctcacttgcctgccccaaatcagaaatgactgccctgctgggcagggagctgtgattttcattttcttgggcagtgacagatgatgttgcagtttctgagaaaattaagtcatcaactcctggacgcccctgacatcatcaaaatgtctgggctggagagccacaggccctcaatttattattggaaataatggggaaaagacaagcaattacgtgttgacatcgggctctgctgctgtgaaggggtggagagctgtaattcctgcccttgggtcgtatcaagatttggaaccaggtccaatctgaaataacataaactaaaagaattgattagaccaggtgtcatttggggtgcatctctctgaactgcccctaaatccctgcaggttataatctaatgcacagtgactgcatccatttccaggggccttgcagggtggcgtggagcaggtgatggatgccccaagccttgtctggacttgccctccccagcgagacgcctcttgtttccctgtcctttctgcactgcacatcatgaggccaccatcaccagcacaggtagaagccctcaataatgaaggcagctgatcacagccagaggtgccctttaaacacccagaggcatgtcacagaggaggtgaaggctgagtctgtgaggcgacaggagaggtggagttgctgggtgccagctccggagacctgggcaaggccagtagtgccaggtaacacagacaccagcagcatccagggctgaggttctgggggtccgccagggactgggactgcttcggctcaaaggcagccaggcaggggccgggaaaaaggagcaagtggtgccctgggttactacagactttgcccacatgtctgcaggggcagggacccagtgcacacctcccggatgtccaggagcagacacagagttcagtggatgggctcctccgacaccctgagctgctcaggtgaagggagggtttgtgtgcaggtgaagcaggcccccgccaacctgacgctttgcctcgagtgtttgccttccctctcaaggctgtctcagggcactctgtgtgctctgtgtgtggggcctggtctggcatccaggcacccaggacaccagatcacatgggggacacgaggaatcacatggggctctctccacagatcctccatgttctcctccttgcccggctccagcaacctctgtcagtcaggggctgttgcccctccacccataagaaccccaggacacacctagacgtctctgggtccctacccagactttcctgtttacttacttatttacgagatactgaacccaatgtgttgccagtccccatccgtggtcctcgggacgcagtggtgaggaggacaggctccttgccctggtgggacttccatcgggtcctggggagtcagacaaacaagacaacaaaaaatgcaaacgtcagttacttagagtgacttaaaagtaaagtgaaagtggtggggagtgagagaattgcatgttactgtagagtacgtgataggagacgttcactttgtattgattttaggggcaaagaacttctatttatgtgcatattgtgtttattgcatatatgccaatttataagacatagatatctatgtgtttctgtttgtttaagcaggaaataataaacacaagaaatggcgagtcactcccagaaaaaggtaaataaatgccaaggagaggagacggatcagccctggccgtcacatgaaataaccaggtaagagaagatccttgaggtgccccaagtggtgacttcaccaagtgtcccaaagaggaaagccagcgtcgcttccaaggtgacagcattagatatccctggtagccattacataatatgtaaatttcccctaaatgctgagatagcaaaacaacagcgcagtggtcaagtcacgtcagatacttttttaaaaagagaaaaattgagcaatgcgttcttgaaaaaaacaccaagtctcaaaaattaatacataaataaagtgaaactttaaaagattcaagacaggctaggcacagtggctcacacctgtaatcccagcccttttggaggccaaggcgggtggatcatgaggtcaggagatcgagaccatcctggctaacacggtgaaaccccgtctccgctaaaaatacaaaaaattagccgggcatggtggcgggcacctgtagtcccagctacttgggaggctgaggcaggagaatggtgtgaacccaggaggcggagcttgcagtgagccgagatcacaccactgctctccagagcctgggcaacagagcgggactccatctcaaaaaaaaaaaaaaaagaaagaaaagaaaaaaagaaaaagaaaaaaaggagagagagaaaaaggattcaagacatagcaagcaacatttgagtataggcaagaagtcagccagctgactgagcaaccaggtcccacctggccccagcctagaactcacacaccaacaactcagctaacaaaggcagctttcctgaaattctgttcgtgttctgtagaatttggaaagagtcataaaatcatgggatgtgtaaaaatagaacctgatagaactcctaaaatcccaggagggcctcagtaattggatctccaggtcaaggtaagaaggaataaggacaaagaaacaaaatgcttacatttttgccatcacttttgctgtgggatgcaagtgtgtttcgcaagcattttcctgtaatgtgggctttgtcggacaccacacaaacttggagcctgggggagccctgagcagctttagcaagcttgtcctcccataaagggtcagaaagaaagtgtttatggttttgcacaactcctcggcggtcatcactattcagttgtgctgtggtggtgcgatagcacatgctcaagtggtgtgattccgttccaataagacttcacaacaaacagaggaaggcaccaaacagaagggaagggctccagggaggggacatggccgcctgtctgcagataggccgggtcaagcctgggtggaccttcacagcagtggtcacaggagtgacgttggctgctgcaggtgggagagggtagtgtggccaagtccagcccttaggcttgtaagggaccacagagggtcctgggagggacaactgacatgttgggaaattgtacctgggaactggaaatccagtctctgtgattctctggcagtctgggcactgtcacacaagagcactggtgagcagatgttctttactgggcaccggcgcccttcaggagtgtcccagagaaaccgcagaaacccacaaggatgcccacaaccaaaagacgattcaacactcacctttacagagggggaagtgagttcacactgccactctctgcaccccgttttccttatgtgccacagagaataaaccaaactcactctgtctactcccccgcctgaggttggaagttagatcaagaggttccacccctgagcccacacttgtcctgcgaagatctcgatacctctctcacggccagtgcctctgcctcctgtgcagacatgtgggcccagccacaacacagactgactccactcctcctaggacaccagactgcactgagacggttgctacctccttcctgccttcctctacttgagtcccagagaccttggctgccctccctgctctcccaatagagctccttcctctctgttaagcttggctcctggtctcccctccactggcctcttaaccaaacacaacactcagcagtagctcagccctgccctgagcctggctggaaatgtgaggggagaagaagccagtgcattcggggccctatagagacatcaaggctgacaaccagaaattcctgttgaggtgggcacagaaatttacacttacggtcaaggataggtcagtccagggtacccttactgagacgagtcctgttgaaagaatcagatgttgaaggaaatagagaatgtagaaagataaaataacttctagacaatagtttcacacaaaatcagtgtatctttgtactgacttttcaaattattttcccacccaggacagcacagaagaaagagcacgcatttttgaggcagacagacctgatttaaaatctagatttggccaccaacttgctgtgtagcctttagacaagtttcttaaacctccacacatctgcttcccctggctcagtgaaatgagagtatcaatggtatttgcttcatgcctgttttgagatccgcaaggtctcatccctgagaagcaagcaccaagagtgttctggtgaacgcgttgtcatcaccgctgcagccaccagctctcaagccagccctggatctccttgtcccgggaactgctccccctctgaatctgagcagcggcttccgaggctctgacccctctctctgctgcctgcctgctggccctagggcctcaagccgcgattcctcaaccctgctgagaccagcaagccattgatccacactgccttctcactcgccatcaaccagctcatgtctcaagattcttattaatttgaatgaaatttccagtattcaaccattttgatctacacaatggctatttgataaggctcaaaccaatcataaaaatacagcaatttgtcgtagtggctcacgcctggaatcccagcactttgggaggccgaagcaggtggatcatgaggtcaggagatcgagaccatcctggctaacacggtgaaactctgtctccgctaaaaatacaaaaaattagccgggcatggtggcgggcacctgtagtcccagctactcgggaggctgaggcaggagaatggcgtgaacgtggaaggcagagcttgcagtgagccaagatcgcgccattgcactccagcctgggtgacagagtgagactctatctcaaaaaaaaaaaaaaaaaaaaaaaaaaacagcaatttttccgagtaagtgcatcccagactcttggattcccagctcgagagtcccagaaggtgcactttgaaggcatgaaaggtgcaggcatgatgaagttgtcgtcttagcacctgcagctgccgggtctgcacagcaggaagaaggcaggccagcccttgcaggtggggccaatctcctcctagactgatgagaacttaacaaaggttttctgtgtcttggcgaccccagacacatcaacatagagtaaagagagggctggactaaaggtttgtgagcctgggttcctaatcctaattctgtcacaatcctaattagccccatgattctagaggcctctaaactgatattgtctctgttttccttttttggaacgttgtgttttgccaaccgcacactgccagtccatggcgctttctccaccacacctttctgggaacctccatgccccatcccccagagtgccaggtgtcccctctgctttgcttctgtgatttgtgaaaaccgacttcttagcaccccttcccgagaagaaaacgaacctgcgcaggaggtgacgtcaccatctggcccaagctgctggagccagcagatggaaaaatgaaaaatagaaccaaactccagggaggcagtgggggggagatgctgaccctcctggggcccagggccttcaaattgttaatcagcaggttggagacagcctggttcccatcctagatctaccgcttactctctgggtgaccttgagcaagttacctaacctctctaagactcagctctttgcctataaaatattatcataacaattcgttcttcaagagaaaaaaatgaggaaaaagtacacaggaagcagttggcacagtggccgtgtctaccacaaggggttggcatatatggtgattgtggtgggtgtgcaatgcccagtggatctcaccaccaaagtggactcctctggttaaaataattgagttaccagaagctgtgtgtgaagtgcatatatggaaaattcagccattctcaaagctgcttcaccttctcacatgagcagatgctccctgcatcgccccccaagctccttcctgagctcatgctgatttgtccactccaatcagtgacccctgaatcctcaggtgctcacagcctgcttcacaccacttagctctgaaggtgaccattttctctttctgccacatgctttggggcatatggggaagaaaaggttatgatctttctgtgtaggagctcatctaggaggagagtacaggtaacacaagaggtgtttgatatgtattcatgtcattgaaaaggaagattcctattaatagaaaaagttgtcctctgttgcctaccccccacaaatattcatttaggttttgatgtgtaaagaagggtgcaccagaccctgaaggctttaacattccaccctacaaaatacttgggaacggttacttaagatgtctacataaattgattccctaacattgttggggtcatagacctctctgagaatctaatgaaagctgtgggtcccctacctagagaaatgcacacacatgtgcgtgcgcgcacacacacacacacacagacacacacacacacaggcttcttggatgccctgaacattcctctctgaatgaaaggaacaacttcagaggcagacagacctgagcttaaattctaacacaacctttctttcaatagctgcaactctgcaagacatacttacctttgctggatctgtttccttgtttttaatatggagataatacctgcttatagggctacagtaaagatgaaataaggtaatgtctataaagcacccagcacatagtatgtgttccaacacatggtacctggtgacttcccctttaccagcaaaatatattgttccccaataagttattaggcgtgttagacatacaaagttagataaaaaaaagaaagacattaaataaaaagtttgagaattcttgctaaaaataaataaataatcttctctaccacatgttttctctgaggctttggtttaaactctcgatgtggttctacaagtgaaagaaggaggatgtagcaatttcacttatttatctgaccttagaacattgtctccatgaccatcatctggacccaatctgggaactgtggccctgatggtcagtatttccactaaactgccaacctcatggagagcagcaccaatcttattcactgtttgttagaagttaatcaacctaaagttagaggtccacacgacaatctgacttctgactttaattatataggtttggggaattccccaaaacactatcatatttgctctagaagccttcacagaactcactaaaagttgtgaaactcacagttatggtttattacaaggaaagggtatggactggaatcagccaagggaagagatacatgggatgcagcccaggagagctccaaatgcagagcttttcttgtcctcttcccacagagccaggacagcatcaatgtgtgacaataccatggagcattgccaaccagggatgctcaccaaagcctcagtgttaagggtttttgttggggtttccttgcataggtgtggctgattgcccatatagctaatctcaatctctaggatctatgacggtctgctgataccacaggactcaaagcctccaccataaatcaattgttgatgtttctgggtgtggccaacacccactctagaactatcaagtatggccatcccccaccttacaacacatttttagattttactgtgtggccaagactcccaggtgaacaaagattctctcatcaggtatgacattcaaaagttttgagctagccaggtctctttttatggcaagtgtaaattttttactgcacattgttatatcttgataaccagaacttggtggatcctcaatggtactttgttgtatggatgaataataaatatatttgtggaattatgaaaggtcttgttaaatcccaagctgcttgggctttcctgccagttctgttgtccccaaacacccacttcttatgctaattactgactcacatatctcttatataaatgtaccctaatcaatagctaagcaaacctgcaaatttcaaattcaacatcctttcatgactaaaagtctcttataatgaataaaggagaaattccctaaatctctacagaatatctaaaaaatacttaagaaaaatgtcatttacttattaaaagctttccctcagaaatcaagaattagataaatgtgcttacatcaccactcctacttaacattatactagagattctattcagtgaaataagggaagaaatggtaataaaaggcctaaaaaatgggacaaaagaagtaaaatttgtaatgtcattattcacaaatgacatcattgcacatgcagaaactccaaaagaatctatagactattagaatcaataagtgaatttagcaaggtgttatggtttaatatgtctgtcaagaagcatgtattgaaaatttaatctttaatgcaacagtgttaagaaatgggacatttaaagaggtggttaagccacgagagcagagccctcatggattaatgccattattgagggatgggtttattattgtggggtgggttctttataaaagaaagagttatctccaccccccaccctctcttgccttatgccacagaatgacacagcaagaaggccctgccagatgtcagccacttgacattggacttcttagcctccagaactgtgggaaataagatggttttctttacaagttacctagtctctggtattcttttatagcagcatgaaatggattaagaaacaaggttactaaataaaaggccatatatgataatcagttgtatttctgtatactagcaaaatgagtagaaaataaataaaatgcacacaaagcagaataagaaacttcaaatacctaggaataaatctagttaaagatatgcaaaatacatacactgaaaactacaaaacattactgaaattaaataagacccaataaatagagagatataccatgttcatggattggaagactcaatattatacatatgtcaaagctcccaatattgacttaccaactcagtgcaataccaataaaaagcctagacatttgtttgtctgtttaactcacaggctgattctaaagtgtctatggacatctaaaagaccaaaaatagtgaagtcagtcttgaagaagtagaaccaacctggagggtctgcttgaccagatgccaagacctatttcagaactgtagtgataaagacattgtggtgctgacaaaggatagtaactagactggtgactaaaatgcagagtccaggagcagaactgtgtcagttgcctatcgctgtgtgacaaacttcctcactacttatctgggtcagaaattcagaacaacaacaggggcagtccactttgctccacaatgcctggtccttccctgcaatagtccaaacatcagagaattggctggaacaactaacggcaatgatgtatctagggcttcagttcttgatgtcagtttttctcttcacttctctgggtggctaatctgggatgcctcctagcgtgatgttcccagggcagtcagacttttcatgcaacagctgctttcccctaccataaaagtggaagctaccagatgtcttgaggcctggcccacaataggaacagcagcacccacatccaagctctgttgtcaagataggctataatcctgcttggagtcagggagaagtgaaatggtgagagagccttcctgtcctgatgagtggggtgcatgtatgtgcagagtggccatctcagaagaccatctgccacagccctatatttgtgcaggcacctattttgtggcagaggtaacactacaatgcagtagagaaaagatggctttttcgataaatgatgctgggtcaaatggacatccaaaggaaaaaacaaaataaattttgacctctactttacacactattaaaaaatcaattatagaaggattgtggatctaagtataaaagatgaaatagtaatataattagaagaaagcctagggcaattcctttctgttgttggaacaggcaaatatttcttaagcaggacacacaaaatactgatcatgaaggaaaaagatgataaattgaactacattcaaattaggaacctctgattatagaaaaggaacattaagaaagaaaaaagacaagccacagagtaagggaagatattgcaacacatacagggctgatattgagaacatacatatattttaatggtctataaatcaataaggaaatggtaaggaaaccaatataaaaattgagaaataagaacttcataaaagagtatattcaaatggccaatacacatatgaaaaattgttcaacttcattagccatcagagacatgcaaattaaaaccacagtgagataccattttacaaccagcagaatggtaaaatgaaaaagacagacaaaacgtttgtgaagaatttagaacattcatccactactactgggtatgaattgctacagtcactttggaaaattgtttagcagtatctactaaggctgaacacacataaacctctgcctgagtagtttcactcctaggtgtacatccaatagcaaaatgcataaatatattcaccaaaacacatgtataggaattgcacagcagcaccatccctaataggccaaaacaggaaaaaaaaaatcaaatggttagaacaatagaatggataaataaactgtggtactgtctattcatgcaatggactattctgcagcaacacaagcaaatgaagtactgagacacaccacatcgtggatgagtcccaaagacatatgagcagaaggagccaaatatttaaaaagtacactttctattattttacttagataaagtccaaaatcaggccacaccaatctatgtttggtgtgtcctgacagacaggagaggggctgtatattagtcaggcttctcttagagagacaggcctaaaaggatagatatgtatttataaaggggagtttattaagtattaacttacatgatcacaaggtcccacaataggctgtctgcaagcttgaggagcaaggaaagccagtctgagtctcaaaactaaagaatgtggaggctgaacgtgggggctcaggcctgtaatcccagtcgtgattttttgggaggccaaggggggcggatctcaaggtcaggagattgagaccatcctggctaacacggtgaaaccctgtctatactaaaaacacaaaaaattagccaggtgtgctagctggcacctgtagtcacagctacaggagactggggcaagagaatcgcttgaacccaggaggcagaggaggttgcagtgagccaagattctgccactgcactccaggctggcaacagattgagaccgtctaaaaaaaaaaaaaaaaaaaaaaaaaaacttggagtacgatgtttgagggcaggaaaggaaacatccaccatgggagaaagttgtaggctgggaagctaggccagtctcaccctttcacatttttctgtctgctttacattcacatgaagctgattagattgtgcctaccaggttaagggtgggtcttccttccccagcccactgactcaaatgttcatctcctttggcaacacccacacagacacacccaagattaatactttgcatccttcaatgcaatcaagttgacactcagtattaaccatcaaaggctggcttgggaagggacaattacctaaaggttgcaatgcgtcttctgagctgccagagcttcttgtgtcttgagctggagctgggcatgtggtggttcattcgccatgtgacattacttgagctgaacttgtcatttgcatatttttccctgtgtgtgtgtgtgttatacttcaatcaaatttagtaaaataaaagtaaaaagctcttactcatgtatttacttgctcaaaatactccatttttcacaattacacaaattagaagagagaaaagggggaggtttgtatgtgagaccaagagagaaaggagacatagaaaaaaataaaaattagtatttttactgaaagtggtaaaactatctaagacatgaaaggaaaagaaggtaattctgcttccctggttgttattgtaattaaattaagtttttgccattagagttgggaatgtctcgttctcattatattttatatataggccatgaaatcacccttccaggacacagaagaggaagtaaattggaattatttttagttctcataaaggttctagcctcaaacagaaaaaaaggtcaagtttaatgattcctcaaagcactaaactagaaataattttttaaactcctttactgtgtcatacctaggtcactagaagacactgtattttcataagaaattgcagctactgtctatgagaactctaattttctgtacaaactgtaccagtttttttccacagaaaaattactgcacttagtagaagaaaaaaattctccctaaaaatgaattgggaaattaaagtgtaagcaacagcatgaattaaaatgaattctccaagagaaaagtagaactggattcctacctcacccaatatgtgaaggggggcttagatgaagggaaagtctacacatgaaaggtagcaatgtggagttcacagagggaagttcaggagaatatcttcatgatcttgaagggagggaaggatttcttaaacaaaacttccaagcaaaaatactgtaaggcacacgcacacacataaacgcacatacgtgcatatgattacataaaaaataatggtttctgttcaaaaaaagacatcatcggcaaactaacagaagacagaaagatattttaatcctccaaactgcaattaaaaagaagtcttgaagatcaacaagaaaaagatggtgaccccaacattaaagacgggtaaaggaggctgggcacagtggttcacgcctgtaatcccaacactttgggaggccgaggccggcagattgcttgaggccaggagttcaagaccagcctggccaacatggtgaaacccagtctctactaaaaatacaaaaattagctgggtgtggtggctcacacctgtaatcccagctattctggaggctgaggcaggagaatcgctttaacctgggaggcagaggttgcagtgagccaagatggcactactgcacggcagcatgggtgacagaggaagactctgtctcaaaaaaaaaaaaaagatccaaatccactggtttacagaagaggaaacccaaaaggacacccaggatgtgagggcgatctggttgtgacatatgtcaccccttgatccccagggtttatttggcgatctggctgactaggcgggtgtccccttcctccctcaccactccacgtacatccctcccaaagctgcacactccgttgaagaggacgaccatccccaacagaggagggccagtcttcggtcaagggtatatgaatagctgcaatcccctgctacaacctccaaacaagctcccagaaggacatctggcaaataaagaaacatgcacacaactaattatcagagaaacacgagctgaaacattgtgatatcacttcacacacttttgattggcaaaagttagtgatttggagctgccgagggctgagaggcttgtgggcagcacaggtggaagcatggctggagtggccattctgaagtatgctttgacactgcttggtcaggtagacctgcacataccctgtgacctggcagaaacactcctggggatgcacctgtggccagcgggacggcgggtcccattccaccttcgctgtcgtagattacacacccacaccctttcccctgtggctctgatgctcctcacagcatgggtggagcacacttccccaccccattgagttggaactgtccaggtgacttgctggggctggtggactcttaacaggacaagacagaggtctcaagtgtgctatgtgtttcgtcttcatctcttgcgctgcagccattcataagaacatgccctgggtagctcctggtccaaggagagtgaagagagatgggagcagaccttaacccagcccactctacccccaaccaagcccagcaggtcacctgggtgtgtctgtgagtgtgctgccagaggagactgacatttgagtgggtggactgggagaggaggatccaccttcaatgtggtgggcaccatccaatcggctgccagcgcagccggaacaaagcaggcggaagaaggtggaatcaccttacttgctgggtcttcaggcttccttctttttcccctgccagatgcttccttcagctcctcctgcccttggacatcagactccagcttctttggcctttggactcagagacctgtaccagtggcttgctgaggactctttcaggcagccttcagccacagactgaaggctacactgtcagctttcctggttttgaggcttttggactaggactgagccactaccagtttctctcttccccagcttgcagacggcctattgtgggacttcaccttttgatcccgtgggccaattttccctaataaactccttttcatatagacatgtatcttacatttctgtccctctggagaaccctgacttatactccggccaaccacagatcagtgagaaagagaagaaaatgcttgttgctgtaagtgcctcaacttagggtggcctgttacacagggcttctgcagcagtagctgactgctgagcggcatgtacaaggagatttacacagcatcacttctgctgacctggtacagtgggttgaatggtggcccccaaaaggagtgcccacccggaacctgggaatgggaccatatctggaaaaagttccttgcaccattaagtgaaggatctgaagatgaagccatcctggaccaggtgggcgctgactccaatggcaagtgtccacagatgagagaagtgggggagacgcacagacctggactattctccaagagaagcagacttctttgttcattaatccactgcattgttggtcccttttgtagcgtggtttaactttactccaactactaccttttaaagaaaaatcctgcttaaataaatgaggaacacacaggtcatggagatctggctatggaacagtgagttctagtctggagtttggactctggcatgtcccatcctgccacctgaatagtttgtccaggattcccgggacacagcttctctgagggaatcagctcagccaaggaataaaggctctctacccactctcctggtgagcccagtgagtcagagccaaggcctggggcaccactgcctgtgcactccacctgccaccctctaagcagcagttgtctctgatgtgttatgttgtgggggagtggtacagatgagaagagcttccagagcctccccacagtcacatctcacactttctcagaagtcagtaattccttgaaaggaagcctcttccttcgcattgaggatatagaacccatatactgttcactatatctttctgtattattttgttaacatttgcaacatatatccttaacttttcacacgttgcttagcgttaattttgtactacttcatgtaaaatatagaatccttgcaactgtatggctccatgtaccctgccccctccttgaatgtaactgatatgcatgccatctgcagatgttataactgggctcactgggctcaccaggagagtgggtaaagggcctctattccttggcagagctgattccctcagaggagccgtgtccccggaatcctggacaaactattcaggtggcaggatgggacacaccatatttattctacactcacaccctaagtattaagaggaaagtagtcctttcaatgtacccattgatttaatatttctgaagatcatcacctctttctaaagatctagatttccatctgggatctctttgtttttcagtttgaaaaactttctttaacatttttactaatggctaattgtcttagttttccttatttgaaaatgtctttattttattttaccttcattattgaaggtgttttgttttgtttttgagatggagtctcactttgttgcccaggctggagtgcagcggtgtgatcttggctcactgcaacctctgccccccaggttcaagagattcttctgcctcagcctccagagtagctgggactacaggcgcgcaccaccacgcctggctagtttttgtatttttagtagtgacagggtttcaccatattgaccaggctggtctcgaactcatgacctcgtgattcgcctgccttgccttcccaaagtgctgggattacaggtgtgagccactgtgcctggtcctgaaggatatttttgctgaatataaattactgggtcaaaaggatgttttttgttttgttttgttctcattttttccccttttgttcctttaaagacatggttccatcatcctctagccaccattgtttctaatgagaagtcagcaatcgtctgaatgattattccagcccacagcatatcaggaaagagaattcactggctaaagtttagcctcagtccactcaagccagcttcttgggtaggtgtaattcctcctcccttccacacgtgagcagcttcctagaacaccaagctcagcgtgtgcttctcacatcggaaacttcattcctgttgtctctgccatctctagtgctatccttccctctctctcctgtagactcccagtcccttcttccttcacacctcttcccaaacactacctcctccacaaattctttcctgaaggatagtctattgggaagcctcattgatgtgtggggtttttttgtttgttttgttttgttttgagacttccacctgcttgggtccaggcatcctcttggcagaagcagctacatttaactgaacagaaagattcatttggcacctacaaaaggcaccaggccctattaaatcagtcagagtgcatgggattgtcacagtggttccatttcattgtcacttctatggaaagatctgcttaaataatattctattgtttgaagtaaagtcaagcactcccttcccatctgtctcctgaaaagctgcaccatcacactaatgggaagaataactgtaacttgaccctttccaatgggactctcaccccactgaatgctgaaaaaccttggacattccagttcagggcctggcccctcaaccttccttgccagttatatctggttgtagctcagcctctgtaaaggagtttaggaaaactgcacaaactcagaggatatcagccccacaagaatgccttcacttcagacaccagccataagttcagggatcccatgaccaccctcaaccttgaacacttgctagaatgacctacagaactcaagagaacgctgttcttaactatgacagttttattgtagtgaaaggataataaattagaactaggcaaagccagagatgcacagagcagaatctggaaggggttgaacatgaagcttctggtcatcctttctccatggagctctagatgttgtcacctcttcccagtaaacatggaatgctgtctgccagggaagctgccctgagcctctatgtccagagtttttattggggctccagcatctactgtccatatggacagacctactgctgtctccatttcctccaggggtcagaactgaattgtcatgtcccagagccctcatcataagtcacagctacactgtccagtagccaaagcccccaggcaaacaagacacttctctccaggaagacatttcagtgacctgggggtcacctcccagtggctgagggcaaaggccaggcctctctttagccaaggttaattcttcattacacagtttttatttctccattagaagaattataaaatattttattttctttctgcttttaaaatttttctataatgaattttttacttacataattcttgttaagatgattgtgaggtggggctcacaagcaggagaaacttcttttcagtgtagccattgatttaacatttctgaagattatcacctctttctaaagatctaaatttccatctgggatctttttttttttcagtttgaaagacttcctttaatatttttactaatggccaattgtcttggttttcctcatttgaaaatgtcttttctcaaccccagctgggccactaagccacagaatgacaaggttctccctaggggaagggcctcagaggtgaagagcagagactcgagccagccacacagacccccaccaccgacctcattcaccaagaggagtgctctgtgtactgcttcatgaatggcagctagtgtccttgactgtctgattactccaaaacatttacccactctcagcctagtcaaattctactcatctctgaaggccagttcaagttcgtcctgcatcaggaaaccttctgtgactgtctcttgccacccactctcctgatgcatgtgcaatgagatagaatagatggtgggtttgtccaaataatttgcaaataagttgtcacctgacctcgcagaagtttccgacaccctgatcccatgcatggtctcactaagaatctacattcagaccaaggccaagctgggccaggtccttcctccttgtcccctaagcacctggccgggctgcaggcagcaggctgtcaacccacagcagctgacgtggaaactgagctgtgttttcctccagcatcgtcttctctcatgaagcggcatctgcagtggcatgggaggcaagcccggccccttcacgaaactagaggccacagaaagagctgctgcctctccacgccaatgccagcagctctccttgtctgaggagggatgatctggctggagatccccacgactttggatgggaggaactgtcctcagcaccgaagaggcacctgttcagttcagagcacaaagtgggaggttgcaaaagagcattagccgtactcgcccaggaggtctgagtgctgcgctaagtggcccatgggaacctgagttccgtggggttgaccatgcctggggaactgaggctaggaggggccccagtgccactgaaagaagggggcatccatttcctggcatcttggggagcctgagggtgaccacagggccaaccccacttccctgctgtgccctctgctttgggggtgctgtgtaatctggggctgaggaaatgtatgggcccaaaggaagggcaccaatgtgtccagaccacccccacacagctgctcagcccatgcgtcaggccaggtgcagaggacgtggcttggcctccagaaggtctgatgggacctttctctcatgtgtgctcccacactgggtgtccctgttggggaaacccaggcactcaccccacagcccccaccatgagagagagagagagggcccttctctatgtggcgtctgatctgcaggctccctcctgaagtctctccagaggagagctctgatgtagggatgtctgcgttgggtctatgtcaatccatagtggattttttttttttttttgagacggagtctcactttgttgcccaggctggagtgcagtggcctgatctcagctgactgcaacctccgcctcccaggttcaagcgattctcctgcctaagcctcccgagcagctgggattataggcgagcaccactacgcccagctaatttttatatttttagtagaaatggggtttcaccatgttggccaggctggtctcgaactcctgacctcgtgatccacccgcctcagcttcccaaagtgctgggattacaggcatgagccaccatgcccagcccatagtggatatttagggcaatgctgctgccagcctcaaacgacaggatgtggtcagatgaagtttgtatttgccttcttaatgaacagtcagttacttagacacttttctaagacaaagagaaatgtgactttgggtttatgactcatgtctctgaaaaggataaaatggtcatacataaatgaaatcaatacctgtaccccacctccacacaccctttttcctctctaacctctccccaaccctgaagacattagatattcaattcttgttatttccaagttccaatcccagctgccctagacaactttctgatgctgacttggatctgcctgtagggagtattgctttgtggaagggactttgagttttgtggtccccatacagtcaattcccatgttagcctaagacagccaatggcatttggtcttctgtgcccatcttgcgtgcttggctaatgtgagttgtgtctcagagacacagcgacccaccagccttgacataaatacattttatgcaggctccaggcctggcctgactggggctgctccccgaggcagtgaagggctccccaagatctcctcacaggcttttcgctgtcctgacagcactgcactgcagcctgcagcaggagtcgtgttgccacacaagttgtgaaggtgcattcagtgtcattctaattgcccagctgcaatgtggagaggctgcattaaggtaaagaccccgaattgcattaggctgctgggaatgggacttgatctctaggaaagtggttctcaacctcgaacatgcgtcagagccgtggacactgacggctgggctgccccaaggttctgactcagtaattctgggctggggcttgaaattttgcatttccaacaagtcctgccctaactgttctagggataatccagggttgatattggataatccagggttgatattgcatcatcaaggaatttgtttcattgcaaggccagtaagtatcaccagtttgtaagcagcttactatttctgtatcatctcgtatttcaggcatgagagcggaggcgcctctgcctggtgagctgaacaaaagtggatccacttctatctggacaaaggcccactgccagcttcaccttcagattttacacatcctcttcctcaactttagagtgacaacaaatgtagttcacacatatgaaccagtgagtgaacgtgtgcaatgaaaatgcgcttacatttaaaaatcaaattgcagcaggcctttctgagctgggcagaccctgtgctgggtctacgacagcacatccccctcagacgtggcccgcacgccgcacatagcccagcgaggggcgttctgcagaaacgtcagcgagctcatggctaacgtgctcagaatagacactgccagctaacttccagtcacctggctatgacacactcaagcctgtgagagtgaaccgggtttgtaaaaaccaggactagtcaaagcccattattaagttttacactttgctccctggcctaagggagtagaaatccaagcttgaagggaaaggaggggtctgatttggtgaacagagatatgaggctgaggcttctgagcacgtgggtttggggtaggggtaggggcgtgggggtactgaagatcaagaagaggctgaggacactcaagggagaaacccgggctctagagccagcccccgtgggacaggccctggctctgtgtgatcttgggcaagtcttagcctttctgtgcctcagttgcttactgtagaatgcggtaactactgctgttatgggcagggttatgtccccccaaatttatagttgaagctctaaccccccagtgtcactatacctggagatggggactctaaggaggtgattaaggttaaatgaggtcagaagggtgggaccctaacccaataagactgtggccctagaagaagatgagaagctctctctgtctgtctctctgtttctctctctgtctctctttctctctctgtgatataaaggtggccattggaaaaccaggaagagaggcctcaggagaaactaaccctgttgatcttggatttggacttggacttgatctcagacttccagggtccagaactgtgaagaaataaatgattgttaaagccacctcgtctgtgacaatcacccccccccccccccgcagcgatttggtgaactggaactgaacatacacaacaccccttcttcttccaactctccttctctgtgcattctttcactcccacccgactcccacccccaaatcttcatagaaacatctggagaatgtgctcaaatctcaaaccccggggcgggaccctgcactaccaagcgcggccactgagcggcactcacacccggcggcgcgcgctggttctcccgctccggccgcgggactggtgcgcacctgggacgcggccagagaggctgaacccctaacgttttattctgatgaatttagattgaaagatggaagctatgtacgttatttttcctttaaatggaccttcatggttccactagggcgacatgttgctgcaatggctaatcattcagcctccgaaggagacgtgcggcgactgaaacgcacgccagattttgaagaccgtaggaaaaaaaaaaaagcgagccagtcattgagactttttaaattgattacatgtggaaatgctaatgttccagcgggactggattaaacaggacattattaacatgcattccacctgtttctggttactttttaaatttggctaaatgggcattttacattacaggtgtgtgggggtgggggctgacctgtggcctcggcttctggccctgggccttcccttcctcccacttgccacgggggccgggtccgggagcagagctctgcagttagggctgctgagaggcgcaggtgcagaggacgggtgggtgcccaggcccagggcacagggtcaggggtcggaaacctgccagtctttaaaactacatttcacagaggatccatcccggccgtctatacatagggtgggtcctccgtcaatccatccagcacccactgagttcaccccatctatcctatgtataagaaaatcgcggaccgatcacgggggctcatgtctgtaatcccagcactttgggaggctaaggcaggtggatcacctgaggtctgaagttccagaccagcctggacaacatggtgataccccgtctgtactaaaaacaccaaacttagccctgcgtgatggtgcatgcctgtaatcccagctattcaggaggctgaggcaggaaaatcacttgaacccaggagacagaggttgcagtgagcagagatcacgccaccgcactccagcctgggtgacagagcgagactccatctcagaaaaaaaaaaaagtgaaaaagaaaaaaaagaaaatcacccagtgcttggcagtcaccatacagccaagacccacccatcattcaagtccaccccaggctggcttcattatttttggggaggactggaccttcatttgacttgctatttaccattgattagggcctagactttgtgaagttacatgttaatttgtagatattttgtcagtagagatgcaaatgatttcagtctggtggagaatgaaatcactgaaactactggcccccaaggccgtggttttagtttgcggtaggatattgatcactttggcctctaacttagcagacttcctttacaggggctgtgttggctgatgaaacaaaactctgtcagccactctttgaaccagttgtacaattttgccctttcccagtctgggctaagcaaatctctgatgtgttcattccagatttgtatgagagtcttatatttaactgttaagtttataaggtttactcaagtagttaactgaatcaggagagaaatttgagatgaggttgaggttaacccctggggaaatgatgtccacagcatcacagggaatggttaccctaagccggggcatgcacgtggggagggaggaaaactggaaagactctttcatccagaaagatgaaggctgagaggggaggcaggtggcatttgtgattccatagacagcgtcaaagagaggaacctaagcttgttgccaaacctgagaagtagaaacctctttcaggtgaaaagaggctgtgtgagaggagaaaggaagggagtctctgcttcaatggtgtcagaagtggaggaatctttgacagatgctggagtcagtctgtgtcccgtgtctttgaggaactagccccgtgagacacagcccctgacctcagggagcaagcaatctagcggtgtccacaaaagcaacacctgaagattaaataatacaaaatacatttcaggaaatacgtagaacatttcaagccactggtgcagacagtgggagctcagaaatcagaggaggaggtgccagtgggactggggtctgttatgttgtacagcaaaacgcaatgaagttaaggacctcgagaggagttgctgatcctgggctatccaatggagtcctaggtacagtcacatgtgtccccataagatgggcagagggaaatcagaagcaccacagaggacagacaagggtcttgaagacagaggcagagactgggggatgcagccacaaaccaaggaatctcagcagccaccaggagacaaagatagattctctccagggcctctggagggagtgggacctgctggcaccttgattccagacctcgggactgcagagcagcaagaggagacatttctgttattctcagccacctggtttgtggtgatttgttacagccaccccaggacgcgaataccttccctcacatgcctaagctgagacggttggaaccacagggcaactggacacacaccccgactctctgcgctgcacttgggctgcctcccagcatggcagtcccaatggtcagacttcacaaaggtgctagcctccaagaggacagttcccaggatggggaagcaagagccccaggcatttgaagaggaagttacccagcctcatccctcccacccctgagcaagcttcagggccagcccggcactagcggaggggaaggagcccattctccccatgagaagactacaaagcacccacccagatggggtatgtggggctgctcctctgagcactgacccccggcttccaaccgcagaccatcctcagagctcagcgggtcccttctccacatcctcaaccctacagcctagagttttcagtgcccaggaccctttcagaacaggaatgtgtggaacaagctctaaatctagagtgtaacttaacacatacataaaattgctttctttcaggtttatttttaagaagcaaatgttattaatttccggagaaggaaatgaaagaagatgctgcaatgatagtgtctgcagaacagcttcaaaatcacacaaagagacagactcatgaaggtgatattgcaaaaccagcatggcatgggggcagacactgtgctgtggaggggacagtgtggaagccacattccctgtttccttctatcctcctcccactctcttgagttgaatcaccctctagtggggcctgggcctgcttgttcacccaacgtctgatgcacagttcattgttactccttcttttaactgcatcatcctttacttataaagaatttggagaggcaaataaggtcgtattaaaaccagttggagcatgatatataatgcatggtatagccaacaagcaacagtgaatcctttgaacacactttctccagtgtgcatctggtaaggaggctaagttcttagtgggatagcgctattattaatcagaaagtttgaaggtgctttttgagaattaaccccagagctacagagttatgcatcattatcagtataccagcctatactttgttcagtgctttacaatttaataagtgcctgatttctttctcagcactatgtgaggaaggtgttaccattggttaaggatgcaacagccaaggttgaaggagactaactgcttcgccgtctgcttattctcagctgtaaacagcttgcaggaggacaatctgcattgttcgcagagaagcaaatatgacccagaggtcagagtcgcaagagcccagcaatttgtctttgctccttaatccactctgtgccatccagggagagatagtaacactgatttctgaatagtgctttgtgtgttacacagtggcttcatatccagcgcctcccccacctcctccgccctcactaggggtggattgcccctgagcagggtctgaggggcaatggatcggggtgctgcaggggctgaaagctgcaactttgcaggatgtttgtgtagtcatgacagcctcgcggaaagccttgggagcatggggcgtcctaatcatcctgacaactccgggtggagggtacaccgccgtgctccatgccatcgggacagagctgggatatgcaggccatggcgaacaagcacacagcacaaacctgtgccgcactgtccaggtcagtgcttctcatccagagaggcttcatccccctggacaagcttggccatgtctggggacagtttggattgtcccagctggggaggggtgtggagggtgctgctggcatcagtgaatgaacggagaccggggatgttactaaacatcctacaaggcacagggcagcccctgccacagagaatcaccaggcccaaagtgtcaatgaggcagaggttgaggaagcctggcataggggttttacctgttatgaacatgttaatccaccggctgatgtgaaacagatgccaggatcagtccccactttgcaattgaaaacagaaaaagcaggggtctcagtccttgtatgaaacaaggtagtttttcagccaaacaaaaaacattaaatgaaataaagtcaaggtactttgaatcattttgcctcataatttataaaaaaaattagcagtaatgaatatcaacagactaagtattgtaaaagaggctttcaaaaagcagaaattacagagaagacaaagaaaataggcaaaaacacatggcttataggagattttgttcatttcttttgctttgtgttaccctcttcccatggtcctgccttccttgggttatttgaatatattttttattccattttaaataatccattgtcctttctggctatatctttttgtatcagtttattagtagtttctctagggattacaatacatatatttaacattttatagtccacttagagttcatatcttaccatttcaagtatattatagaaggcttatgactctattggttcatttatcctcctctccttatgttataattgtcatatgtaccacatctcagtaataattatacccagaaaatgttacaatatttgctttcaacagtcatatacattttaaataatttaaaaagagaaaaagaattcattatatttaccagatatttatcatttctgttgctctaatgccattcctgaagttccaagtgttcctccagatcatcttcctttttcctgaagaacttggctaagcatttcttttataggtctgttagtgacaaattctcttactttctcttaatctgagtatgtccttatttcactgtcatttctaagatatttttgctggatatagaattctgggttgacaattattttctttcagtaatttatagatgttgttccaccatcttcctgcttcctattttctgatgagaaatttgcagttatccaaagtactcttctctgatacatagtatactgtttttatctggttgcttttaattgtctttcctttacctttgattttcatttacaatgcattttttttaagtttatcttgtttagagtttgttaaccttcttgaacctatatatatatacgtttttcatcaagtctgggaagtttacaaccattatttcttcaatatttttctgcaccagtgtcctcctcctcttcttctgagactccaataataagagtattagactttttgatattgtctcacaggtgcttgaggctctgtttttgtttcatttttttttctctcaatcttcaggctgtgtaattcctattgattaatcttcaagttcactgacaatttccaggatatctcccacaatttttggcattcagggctctcctttcctggttcttctggacagaaagatagtgttatctccaagatttagcttcccgcactgccatgcagctctgcgtgactaggactaccttaggaataaattggtaaaagaaaagacaaaaaaattaacagggattatccccccatttttaaaacagctggagctctttttccagttttcttctgtccagaaaatcaggtttttcttagctttttaattctttgtgctattgtatagttccacatgactggggccatctttggagccaagtggcaacagtaaagaggaagaaataaacagggattcaccccactccatttccagttcctctggttggagagttgggtctttcatcaaagtttcagggcttccagcaccaggaccagcagcatagtggtgcagctccacagctggagctggccttgggtcagggtcaagagaggaaagaaaaagaatagtgaaaatttctcccacactccctggcacgcaggggtcccttttcctggtcctttggctggaaagagaggttttatcccagatttttgtcttctgggcccactgcacagttctgagattcaacccaccctcaggtcagagctaagagacaaagaaagaggaacaaggcaaaactcacccccatttggggtcattatcaagttttgacatcagttgcccatccttttgtcgttacttactttttagagggctcagggagttgttctttatgttcctcccagagttttcagcgttcccagtgggacggtagacggaagtgcacgtattccaccttggctggtaccagtggtcacttatagaaaatgcaaattctctcagcccaggttggagcaaatgtacaaaagaaagtaatgatataaaagaccaaaatgacatgatcaatttagtatacctgagggatatctactaaactttaaatcctaaaaatatagactatattgtctttccaagtgaccatgggacacttccaaaattaactaataaaccacacaaataacttcaattagttctaaagaggagagataatgcagaaaacattttctaatcacaatgcaatgaaactagaaattgataagaaagtcacaaaaccaaaaaggccttgacctagaaatcgtatgattccttattaaccaacttttgagtcagagggaaatacaaagtgaattatagaatttcagggaaacaacaatagtgaaaacattaaatgttagagttgagaatataaatacagtagttgatagacttaaatatccatatcaggtatagatatttaacaacactgcactccttacttcctgtcctaggtctgacttccacggtcttgctggacacagaccctttgtggacatttgacaatgtctggagacattggagtgacatcttgttattgcatacttaatagactacagtatagtataaacataaatttatatgcactgggaaaccaaaaattttatgtgactcactgtattgccgtattcactttattgaggtggtctagaacccaacccacaatatctccaaggccagcctgtatgtgatctcatttactctttataaagacatctggcgacgaaaaatctcagaactctttcacagataagaaaacttaggctaagacagatgtagggagaagagtgaaaatccccaaaccaccttccccattttttccttccccagggctcaccccgaatcactcagtgctgtgtcacgtgtcatccggacgtttttccttgagtgacaggcatgactacgcaggaaggcagaggatcgctgtgggccggaggcctgacccaccctcagaaatggtggccaagcccctcagggccacttcgtacagcaaccctgtcaccatgctcaccggaaactggtctgatcagtcctcgtgacagcagagcaggaagagagctggaggttcatcaggagtcacccaacacgtcacagaccgggacatggaagccaagagaggtgtggttatcctcatcacagttgacgatgatcctcagtgctggccaccaggatcaaactagccaccattgcctgagttctgcgtgcagctggtctgcagcgctgccccacatgggaccctctccttgaggggcacatgaccttgggcagagcagctctcttgcgatgaggcgatgagggcctcagcccgaggcggatatgggccccacaccccagtgttcaccacagccaccaggatgctcactttaacccggcggtcactgaattgaacaaggcacaggtgacccctctttgcgagtgacctccaatccaagcatcctgcagctgacccaagtcctcaccctggaactcttccataagtgtcggataactcttattgctgactggttttagctcaagaccctttgagttttaggaccttccacaaaacactttgcaaatatagctcgtgagcattgaaaaacagccccttcccccaccaatcccacgataagggagcctgagagtcagatctcatctcaaccaaggctgtgctctgaatcacccaggaaattccccactgacattcacatgcaatagatgggggtggtggaggcgtctgtgtgtgttgtttttaagcatctcaagttgattaatgtatagccaggttgggaattactgctctagtggaaaacttactaggcatagaagcagaaaacgaggatgtgtggaaacctgagggagcaggacagcttccttagcctaagtgtctttatccatcaagcatagttgatagaacaaagcaggttcacagacacactccaggatgctggaggctgggtacgggcccaccccttaaagacagcgcagtgccaacttttcccaattcacagcaggggaagttagtggatagaattgcccaattttaacttttggttccttttctctcataatcttttcttggccttgacatcttctaaaactcctctttctaagccaatgaccaacaacactgccattgtcccagtgaaggctgcctttcccatggctgagaagccaggcgagccagaggcatgggttctttgctccctgatctcagggctggtgcaggctctgcacggcaaggtgctgacaaggcctggcaaacaggtgctcagtgcctttccggctggaatcttatgctttgtcaggtgagtgctcagcaaaaagtgaagcaaattgggtccccgccattctgtgccagtgatgtagttttcagacgttgaccttccgggtctgtgctgatgacccctcatggtgatcatgaacttctccctagacctccgtgtgaggaccctctggaaatctctcaccacacctttcaactttagcccatcactgaaatgatcacatactgcttatgaagacgttgggacttggagatgcgttgatgtgcacatagcccaacttcaaattcaggctatagcatccctggaggtaaatattgatttggcatttcagttctatcaatatttacctcttaagtcaataaagcttgatgtttatctcaactgacattgatatctgcttaaagtgtatttctcacttccttcccttcttcaaatagctggagaagagcttgtgttgggcaggtcagagggaatggccgatggacccgctggtatggaatgagtcctgagactctcatttcctctctgggcctcagtatcccagtgaagcagctacgtcgtctggggtagatcccctggggcttgttgtcgcctgccaggaaaatttaggacagggacactaaagaggagtataggagtggaggtttaatagggggaaaagagaaagagaaacagcttcctctgtagaggaaggggtctccaagcagaaaggacgcactggtggtgaatgcactgtgttttatagtccagtttgaggaggcagtgtctgatttacgtagggctcacagattggttcgatcaggtatgaggtttacacagtgcgtggggaaggctgctcttattatgcaaatgggttttccagttgataggggccatcttgtctgctccttacagaacacgtggctggcagagaagtaaaggtggagctgccatcttgaaaatgtctagctctgactgggctcggtggctcacacctgtaatcccagcactttgggaggccgaggtgggcagatcacctgaggtcaggacttcaagaccagcctggccaacatggtgaaaccccatctctactaaaaatataaaatttagcagggcatggtggcagatgcctgcaatcccagctactcgggaggctgaggcaggagaattgcttgaaccccggaggtggaggttgcagtaagccaagatcgcaccactgaactccagcctgggcaacagagcaagactccatctctaaataaatgaataaataaataaatagatagatagataaatgaaaatgtctagtctttagttcctgccagcattcacccgtgcaagctcccagcttgcaggctgctctttgttagaaaatgatttggggctgcttttcgttaaaaaggaaagccttatggaggactcccatacccttgctatctgcctaagtaattccttcttaactcctggatctctaggttgtttcggagaccacttcgctgctgacatctcatggctccgctgttgcatattcagaaggacagagcaggcgggcggcctcaggtttgcaagtggcaaaacctgaaaaataaaacactgttttttattctgattgactttttaaaaagtgctgatttcagctggtactgcttggaagcaaatttctggggaaagtaaagtcataaaaacaatcagacagccttaaaactgggaccatgaagatggggtcccatcaaagaatcctggctcctatggttgaggctcagcggagggagcagtaagttccctgcaacgtctccaagcctacagcccgaggcctctcggacccgacaccctggcggacagctgcagaggggcagccccaccacgcctgccttgctcagaggcaccccgggaccagcatcagctagcagagctgggaggtcactcaggccaaatgctggcaatttcatggagaacccacagtgacagaacttccacagaggactgtccttgagatggtaaaatcagtgaaatggagtcagtaaaaccgagcacacgaggcctggtgcctgggagtgggaggagcccaggcagccttcaccagtgtgttggttcattctaacgtgtcaactcgactgggccacaggatgcccagatatttggttaaacattattctgggtgtgtctggatgagattagcatttgaatcggtggattgagcaaagcaggtggtcctccctgtatggctgggcctcttccaagcagctgggggcctgaaaagaacaaaaagcactggtcagggagaaggccctctctgcccgttttcaagccgggctggcagtcttctgcactcagactggaacttacgctagtggttcgcccaggcctccagcttgccaactgctgatttttggacttgtcagcctccacctccatagcagcatgaaaaattcctcatcatcaatctctctatgcatatatcctatatatccttttggttttatttctctggggacccctagcacaccaggcaaggtgagaggcccttgaggaggaccggctgtggctcgctggtctaaagctctaagctcctactgctgctgactccagctctgcagaagatacagtggtgacatctcctggctgccaaaaagacgggtgagtgtgagcctggggctctcagatggctgcaaagatcagggtatccagggtgttatgtaagcaggcagcttcccctgcagtctgtgctctaggctcaaagcacaagggccacaaagaagcccagcccaggatcctgtctgcccggtgagctgggcaaggtgagcatgcctgaggagtcatggccgagcacgcagcactgagcacagatcctggagggagagggatgaccctcagcccctgccctccgggacctcatggtacaggtgagggagggtgggtgctcaggttggagtcagtgcagctgaggaaatctgcatgtgccccttgatggcagagggccccgggatgcttcccctctctcagcccccactggaacgcagccgcaccttccccagaggacgccaggtagactcagtggccagaggttagggggattctgcacaggcggctcagggtgtgctggcacataccaccctcgccagggcccagggcccttgaacgccccagtgttcagtgctggccttgaaccagggatggccttcgggtgagtgctgtggggctgagtgagcctgaaggaggaccctcgggtgagaagaggcttctgggaggagcaggagagagaggaggggatttgggagagagggggaggggaagggacagggagggaagacagacagcccagctgagtggggaggagacacagggtggaaggctgggggttgcccttgaggtttggagtctgagtctggatcagggttctgctgctggtgggtgaccctgctgctggctcagccccaatcgggggcctggctgcctcactcagatgaggggccgggcttccctctcctgctttccagtgcttggactgtggcagccaccacacccacaagggagttggtggttgattcccaagggtcctcatggtggagttccccctccctgctctcccttggccctgtgggtgcatttcctggcctagggctttgtggagtgaacagtggctcctcctgcttttgtgggcccctagccagtgaggtgaggccagacctcctgaggggagggtcccatgtccccagagtcaggggtcggggtcaggggttgaggtcagtgggtcaggtgggtacattgcagtcagcatgtactcaggactgcctgtgacccagaaaaggctttctcaggcctattcccacccgcaccagcctggagagagctctgtcaggctgaggtggaattttccggagccccgggggctgtgcaggtgcgggagggagagtctgtcaggctgaggtggaattttccagagccctgggaggaggattcccagcatcaggtgagcggtgacttctgacgcactgtggaagctacaggcagggctgagtcggcggcaaggagcaggacctcctgttagaaagtcccagaaagaaacaaaccctcggggaccacccagaaggccaggatcatccgaggggccgccccgtggggtctccatggctgcacgtgcatcctgaggcccaagtcctcctcacagtggcttcactgggtgctgggactctgcagggaccgagctgttggtgctccagcattcagggagctcctgccttggggtggacagacagcaggtaaagaagcctcatgcagggcagcaggggataccctgggaaggaaagtgaggcaggaaacagacactgggccagtggctcctggtgaagggatgggcactcggggatctcggggagggtccaggtgaggacagcaagggcagaggagcctgtgggaggggtaagcacgagggaggccgaggccctgagatgtgaggcccgcatcctgctgcaggcgctctgcctccagcaagaggtggctctgggggacagctctccatgggggacagctctccatgggcttggacacccgtgctcccagacaacagcttctgccgtgctcccagatgagagccagagccctgcctatcgggaggccacactcatgcccaagacttctaggcctcagcagtgctcccaagggtgtggcaccaggtgaagcagggcaggtgtgtggaccaggtgtgctgggggggcagagggagggcagcaccccgtgggccagctacctcttgtgtgggcacacagcacctgtgcactcaaggtcacccatgtgcacgccgcctctccactcctggcagcagccaccctcgcaccatgtggctctgtgtcctggctccacagggctccctgctgctgccaggagcaattcctggagtccagcatgtggaggtagcagggcctctgctggctttgggactggaccagcagcactgcaggtgccctggctctcccacctgggcacacctgaggcctctcgcccttatctcccagggccctagcggttcccctccaccatcccatcccaaagcctcacctttccagtgtagccccaggccccagagcaggtgtatccactttattgtacacacagcatttgactcagagcccaagacatgtatctgataggaatagggctgctctggatgagggagggggtgcccagccccccagcctggctccccagcacgcccactgccctggctctgcggagcaccttccagaccatatcagaagccctcagggaggcccctggaccctgacatccccgagaccccctgagggacccactttgctagctgcatgtctgtgtcacacggaactgtctccatgctctgcaagcaggtggaatgcaggagcaggcaggaaaacccagctcttccaagtcagacactggagagctctgcagacacgaagacaatgccatgcctccccctaaatgctttttgttttggaaaatatagctgttcgtcataaggtatttacgttgacgtatgacaggtttatgattgttttaatgaattaataggtattttaaatgctcttagtttcgatttctagtgtttctcattggtgatttctaacgtggcatcgtggctgcattcaacccccataaacgcatgctccgtggtggcctccatagctcttcagacccaatgtgtgagtcccgggctccagatcgtgtctcagcccctccctgctccctcagccaatagcctgtgtccgtgtggcccctcccccgagcttcccagtgacggaggaaggcagacgccgcgtgctttccaggcgctgtcctaagccctttgcagatatggagccacttgaccctcctataacgcgtgcagtgggtcctattacccccccatttacggaccaagggcagggaggtggagacactggctggaggccgcgcagcagggaagtggcagtcaggaggcagcccaggccctcccatccgacttcagaggccagacgcacgccttctagacgctgactcacaagccaagtcactccttcctgacactcacgccaccatgtcctccccaaagtgcatttgcattttaacagccatcttccgtgagctgactctgtggttttcagtcagtggtttccagtcggctatttgtcataaggtatttacgctgacgtataacaggattatgagtgttttaatgaattaataggtattttaaatgctatttaaatgtactacctcaaaaggctgagaaatgtggggcctctgtgtggatgtgtcagtgtgtgtgtctctgtgtgtgtcagcgtgtgtgtctgtatcagtgtgtgtgtctgtgtgagagtgcgagagtgtgtgtccgtgagagtgtgtcagtgtacgtgagtctgtgtgtcgtgagtgtgtctgtgtgtgcccgcgtgtcagtgtgtctgtgtgtgtcagtgtgtgtgagtggtcgagagtgtgtccgtatgtgaatgtgtcagtgtttgtgtgtgtgtgtcagtgtgacagagtgtgtgtgtttgtgcctgtgtgtcagtgtgtctgtgtgtgtcattgtgtgtttctgtgtgtgagaaagtgtgtgtccgtgtgtgttagtgtctgtgtgtgtgtgtgtgagtgtgtgtgtgcacgcatacacacgcatataactctgctgtggcttctataacaaagtaccgtggaccgagcagcttgaacaacagaaactcccttccccgcagtcctgaggtccggaaatctgagatcacggcgtgggcagggctggttcctcctcaggcccctccgtggcctgcagacgccatcctctccctgtgtcctcacgtggtcatccctctgtcagcgtctgcttcccaactttttcttcttagtccgttctcacctggctataaagaagtccctgaggctgggtaatttatgaagaaaagcgctttaattggctcagggatctgcaggctgtacgggaagcgtgacgtcatctgtctctggggtggcctcaggaaacgtccagtcatggcggaagaagaaggggaagccagctcatcacagggggaagcaggagtgagaaagaggaggggggatgtgtcacacacttttaaaagaccaggactcctgtgaacccagggctcgagctcacttatcaccaagaggctagcccagccattcatgagggatccacccccatgatccaaacacctccctccaatccccacctccaacactgaggatcacatttccacatgagatctgggcagggacaaatacccaaactgcatcctaaagacaccggtcagattagattagggcccactccaaagccctcatcttagtttagttacctcttgaaagaccctgtttccaaatacagccacattctgaggtcctgggggttaagacttcaacatatggatttgggggatacaacaaacgccatttgggggtcacagtgactgagggtgctcctggattttgttggggtgatggttgagcaaggttgctattcacccttcagtaggtaggacacccccccaagggatatctacccagcaaaacgccaacagtgtgctctctcaggaagacttcctgaaaacaaagagccaggtagaatctcagcacacggcaggtcgctggttgatgttttcaagaagcagctttgggggtttcctcaaatccatccaatgagattccatctcttttatctgagcatctaggatgttcaaggagaaacggctccgctttttcctgcttctccaggaatccagcttagtgggtttacctgcctctgtccaaggtgctccgttgtgagtagcccctgcctctgggtgtgcaggtgatttggggactgagagctgaggcgctaaagttaaaatggcttaacgtgtgtgactgtgtgtgaatgtgtgtgtgtacgcgtgtgtgcgtgcgtgtgtgtgtctgtgtgtgggaatgggtgtgagtgtgtatgagtgtgtgtgggaatgggtgtgtgtgggagtgcatgtgtgtgggaatgtgtgggggaatgggtgtgtgtgggaatgggtgtgcgtacgtgtgtgtgtggaaatcggtgtgtgtgtcttgtgtgggaatgggtgtgtgtgtgggaatgggtgtgtgtgttacagtgtgtgagtgtgtgtgtgtgggaatgggtgtgagtgtgtgggaatgtgagtgtgtgtgtgggaatgggtgtgagactgtatgagtgtgtgtgggaatgtgtgtgtgggaatgtgagtgtgtgtgggaatgggtatgtgggaatgggtgtgagtgtgtgggaacgtgagtgtgtgggaatgggtgtggggggaatgtgagtgtgggcatgtgagtgtgtgagtgggaatgggtgtgagtgtgtgtgtgggaacatgagtgtgtgggaatgggtgtgaggggggaatgtgagtgtgggcatgtgagtgtgtgagtgggaatgggtgtgagtgtgggtatgagtgtgtctgtgtgtggggaatgagtgtgtctgtggggaatgggtgtgagtgtgtgtgtatgactctgtgtgtgggaatgggtgtgagtgtgtggggggaatgtgagtgtgtgggaatgggtgtgtgtgtatgagtgtgtctgtgtgtggggaatgggtgtgtgtctgtgtgtgtgggaatgggtgtgagagtgtgtgtgtgtctgtgggggaatgggtgtgtgtgtgtgtgggaatgggcctgagtgtgtctgtgtgtggggggagggaatgggtgtgtggggggaatgggtgtgtgtgtgtctgtgtgtgggggaataggtatgagtgtgtatgtgtgggggggaatgggtgtgtgtgtgtgtgtaggaatgggtgtgtgggggaatgtgagtgtgtgtgggaatgggtgtgtgtgggaatgggtgtgtgggaatgggtgtgtgtgtgggaatgggtgtgagtgtgtgtgggaattgtgtggggatgggtgtgagtgtgtgtgggggaatgtgtgtgggaatgtgtgtgtggggatgggtgtgagtgtgtgtgggggaatgtgtgtgggaatgtgtgtgtgggaatgggtgtgagtgtgtgggaatgtatgtgggaatgggtgtgtgtgggggaatgggtgtgtgtgggaatgtgtgtgtgggaatgggtgtgagtgtgtgtgggaatgtgagtgtgtgtggggaatgggtgtgtggggggaatgtgtgtgtgggaatgggtgtgtgtgtatgagtgtgtctgtgtgggaatgggtgtgagtggggaatgtgagtgtgtgtgggaatatgtgtgtgtgtatgagtgtgtctgtgtgtgggaatgggtgtgagtgtgtgagaggctctttctcaagactgtaggagtgggggcttctccatggggacactttcaaaggaggaagaaagaacaaaggaagaagggtggatttcactcctttccttggaaatgagtcatgactgaacaatgaatttggggaaattttattgaatttcatgccacggccttggtgcaggcaccacatgatctactacattcggggcacataggtgacgccccccagctgtgagggcaggtgccccgagactgggtgtgtgctgggcattcctggcaggcgtcacgtcccctttggcggcagattgctcctgtggggcactctccaccgccttcatgggccacggtgaatgccagccgtgacatcggggcaagctgcccatcgaggaagccgagtcggctgtctgctgacctggcagccatgcctgctggtgcttcactccctgcgagcaaggggcttagggactgctctaaagattggggtcagaatcccagaccccaggaccccccatcctggcccgtcctcagggagagctgccaacagggtccccacccgttccttcctctgctttctttccacacttggagccagctttcttttttgttgttacaaaacctgtattgaagaacaacagactctaagacagaggtccctcaatgtcatcaccaaccccatccgtgttggcgtcggccctgtgcctcctgttcctgcccgtgtgcatgttcatttttacagatttataatgacaagagagggtattgtcctctcttccctaagtttatgccacgtggaccttctcattttcgctggtgccttcctttctcaggaacctctttcccccgctcccttccccctaccctgctccattcccacccctcccccgcaccctgcacacacctttcatgcccctgctcctatgagcaaacacagcatgcgtggggagggtcttcactacggcttctcctccgcagcttgcttaattgctccgtggtaatcaggaccatctcccagtttgggaaccggattccttctgggaggtgggggagctggaggggtaggagcctcagaggagctggagtcctgctgagacgccccacccccatcaccatcatctctcccccatcttattagcaggttcctgcccctgcacttggcggtgtctacccaagctgcctgagccggccatgtgagcagcgcctccagtaccgccacagtgaaagggaggccgagcatcctggagcccatgaacccacacagcccccataagctgcccaacatcttctggtggtttctgttcaaccccagagactcttggagtttaccttaacactgtcaccttcccaaactccatggaggaggggctgagcctcttagcatcttctgggacggccccttcctcatgggggtgggtggtgagggcggtgcagggggagactaggagggctcctgcatctcctggtccctctgtggataaatacacggccagtgccccaggcctgggtccatatgaacactctccctcccccaccaccaggaaaagcagtcacagctacaggtgggcatcctcccctcctccccactgtgctcccaggcacctgctggctgtgctatgctctgcaacacagggctgccggccagggtggggccacagttagtctcattccacctgtgccgtctctgactcactgcactgtccgagtgggcagaaggtaggtgccggctccagggccaggggacacttagcaactgctcagaatctcccaaaggtggcttttcctcaaggtaccatctccttcctcctttcaccagctctcccaaaaacaggtgtgagaactagtcccttgatgtgagagatactgtgaagttcttgctttattttaaaccccagcttaatcagatgatttttcttgtgggctaagcactttcatcctttgcctccttgagaaaattgtcaaagctgaaggtctccttgccaatgaatcaatttctgcctctagcaccttttccctctttcacttccattgtgcaaataaccagttcatgctctgggtcggttggctgagcagacaggcaggtggcacctgcacaggtaagtggttgggatgaaagtcaggtccttttttctccctccacaaccagaaccccaattaacctggtacccacaagttcccgccctggctagcgccctccaactgggcccattttgcattcaatgcgattccaaaaacaaaaaaaagtgtttcacgtaagcccttaagatacaacaagagtagggcagaattttaatactggttttgctttaagacgcaagtaagtctcttttgggagccagcatgaagtgggggcaccaccactatccaactgcagatggggttggctccaggcaacaggtggatgctggacggggaaaccaggaaaggctgggccctacaaggagcccaccatgacctgcaaaggccaaggaggccaagcactcaggaactgcaggaagacaggctgtaggggacatcaggagaactaagtgtcttagtctgttttgtgtttctataacagaacaccacagactgggccgtttataaagaaaaatttattttgcgcagttctggaggttgggaagtccaaagtcgagtggccgtatccggtgagagccctcctgcagcatcatcccatgacggaaggtgtcccatggtgagagagcacgtataccagctcaggtctcccttccttttctcataaggccacatcccccatcgggtcccatcctgatgtcctcatctaatcctagttacctcccaaaggccccacctccaatcaacatgtgactatggggagtaagtttccagcctatgaaactgggggacacattcaaaccacagcaccaagcaagctggagcagccaagaggaagccacatgttcctgcagggcagggcagcctccaccatgcagggctgggacaggccagggcagtgagggctcatgggggccgcacccacgccagctcctgcagcaccagcctctggccagctgtgtgcctggagcagaggggagcaggacccacgtcccagtcccccacatcccagatctcaccgaagagatcaactagcctagggccaggccagtaggagaggaccttgtccattttctccatgaaaagtcaacatttatctctccaagtacaagtcacttcctaatcttgagatgtgtggaaacaagctctttatgctgaaaatcaacttctacattttagttctgagatgtgattctgccagccatggtggacgaggaggatggtagggacttagctagagtagcacgtcctcactagacaggggtgggtggtgtggggaggtggggggcttggccttagcctgagtgtgacgttcagcctgcatcttgagcacagtgagagcctgagccactgcaccactgaagatgcttagaagagagaccacagcaggcgaggaggcttcccaggggtctgcgctgacaaaccagggatgagggtggccagctgtgcatgagccccccagcgcccatgcaggcgtccccaccttcaccacctaagtgtggtcacgcacccagggagagctttcaacctggctctctcaagtgtgtttctaaacactagagccaggaatcctgtcctgtgggtccctgaaacataaccggtgagcccaagatctcctcggagaaacaaggctccccttagggagggcccaggaacgtgggggcctctgtgaggcagagggtcccagagggtatgaccgtttctgcagaatggtggccactctgcagaaacaaaatcacagcccaggaagagctgccaaagtgggggccaggggagccggagagggggactgagccagatgcctgcagagccgtggctcacagcctctaggaggtacgcccatgaatgtttcagaacacatttgaggactgacgtatgtgaccaactttttcttttgttaagcaaggatttttaatcaccattactggattaaagaaaaaacattttggctgggtgcagtggctcacacctttaatcctagcactttgggaggctgaggcaggcggatcacttgaggtcaggagtttgagaccagcctaagcaacatggcgaaatgccatctctactaaaaatacaaaaattagccaggcctgatgacacgcacctgtacacctgtagtcccagctacctgggaggctgaggcatgagaattgcttgaacctggggaggcggaggttgcagtgagatgagatggtgccactgcactccagcctgggtgacagagtgagactccatctcaaaataaataaataaatgacattttaataccacaattaggataatttcagaataaaaattttttttctttaaaactttgtagaaaatcccacacacccaatttggccttgtctgggaaatgtgaggattcctgtctcctgggacagacagtctcactgccaggcatcctccccctgcagtgattcacatcctacaatgtctgccctgatgtgtcaattgtagagtaggtccctcatggaggcccagaggccccagcccagagcccgtctgtcagtcattggctgagagtggttgggacaggtgaccccgcagttgaggcgaccccccacgatctctggaaaaggcagctgagccccagttgcagcaggttgggggagatggtgctgccacagcacaaaggacctagccccagtggcacccaccactgtcagaactctccactgagggccagggtggatctttcctcccacatccaagcgcatctgacatcttcaccttgaatcctgagtttctctcttaactctgtctcactttgtcatgaacaaactctttcttgaaagttgtatttctctggggccagaaaggcgaggaaagaggcgctttctcctgggaggtgggcctcgtgtgtccctgtcgtggctgagagtgactgccccagcacctatgaagaaagcccagagactctggaggctcagctgggataacgcctggcgtgctcgggggtcatggccaccgcctggactctggaaaaatgggaaaaatgctcttggcagacagcggggcagtcaggagggagctggccccaccagcccaggcaacgcccaagagctgtcctcccactcggctccaggagacgtttaaatggggcctgactcccccatctctgatttaaaagataaccagaagcagcagagaaaacatctgaagtgcttcctggacacacctgttaggaagtttctgcaagaacccaggtaagagctggactaagcgggggtccgtgggtgggaggagggagaacgcctgcctgggcatttacagagatgagtttgcagagataatgatgccagggtttcagccccagccccaggaagagaacggcagcaggaaaagttagagaggagagggagcaggaggtggagagctcggcccctccttcgctgctgccctctgggtgacgctcagcggaggcgccacgtagcagctgcgagagccccgagacaacctctgcactgtttatgggatcgcattaggggagcagcggccctgcatgaccccacaggtgagcaggacacctcatcatagggtaggcacgtgagcagactcaccctcacacagctgccttcagggctgcccaggtcaggtgctcagaacacaaaagaaagtgagacaaagtcgccaccctggagtttacgagctggcgtgggagacaggctggcactgaggatgacagtggagagagatcgggctgggaagaaccggaggcgctggggaagccgggtcagcagggagaccccagcagagtgggagccggaggacggcggcgactgcagcccgactgtttcaggtggcgtcctcgtcacgagaggagcttgagcgggtcgtggccttcctggcaacctgcctacagagaaaacgattgctgggtgcagatgtctcgaacatttattgcattccacgttgtcagtcaataaaacagctttgcgagcgtaatactgacaaaatcaagttcaggcggtaagccccagggcttccaagaaaagtggatcggggggcttgctcagctctggtatccagggggggccactgcctggttcccaggcaaaggagtacaaactgccgggagaaacaaggaccctgcaggaagaagggacctgcccgacttgttcccccgcacccacatcaggaattttcccagaaagccatccactttgttagagacaaaataaaggtcatttggagaaaaacctgccagcagctgctgctgcttgaaaatagaaaagattttaaaagtagcagtgttgggaggccaaggcaggcagatcacctgaggtcaggagttcgagaccagcctggccaacatggcgaaaccccgtctctactaaaaatagaaaaattagctgggcatggtggtgagcacctgtaatcccagctactcgggaggctgaggcaggagaatcacttaaacctgggaggcgaagattgcaatgagctgagattgtgccactgcactccagcctgggcaacagagcaggacatcgtctcaaaaaaaaaaaaaaaatgcagcagtggtttgaaatcatgcatttttatgtgttatcctcaaacatctgagggagataagaaagaatataccacggatgagaatatttataattatcagaaaaaaaactgcctcctaggaacaatcctgtgagctccatcatcaaatctgattcagaagcctccaaatcccctacttgccctggcagctgctacccacctcacagctgtcctttgcagattactacaaatgttctcttaaatattcatttatcccccagcattgacaggtgaggaatgatgttgcttgggctatttctgccccaggtggcccctgtaaagccgggaccttggatcccctctctcatatgagcctcctaagcgggctcccagctcctggatggggtcttctcagggcctagggccccctcatctgcccagaacaaacttcctcatccagatgtcaccattcacttccccaggtcctccttcccaccagacatgaggattttaacttgatcatctctgcaaagaccttatcttcaaatacagttacattctgaagtcctgggggttagggctgcaacacccgaattggtggagacaaaatccagctcctgacaataccgcgtatgatagctgcgtctctgcctgcagtactgttttccagggaaagcatctttgagtgtattcagaaagcctctctctggggccaggccttgcagagaatccttcagaaactggacaaccccacccaaggcagtcagtggggaggacacatttggtgcctcattggtccctggatctgcctcacagtcctcaatgttcctcctcgttccctctactctttctcctctttggttgaccttgaagctcattcctggtgaaggccccgtgggagcagtgcaatgacaagaggagcctgttttcaatagcaccctcacgctctccaggggtccattggaggcgcctatgacctcctgatgctgaggagcctagagtgggcagccctcgggcccaggctccacctgggtgaggcctgttttattatcaatactcaccacagtcatttgtgggagtgtaatgctcatattcccatttaagagatgaataaactgaggcaaggtgaagtgactcagctgaggccacaccacagtttaatggggaagccaggataagagctggcggcttctatgtctgatctacactctgatgggaggtcgtcagagagccatgtaaacggtgaggaggtgacatgctggtcccttccataaaagctgttttgcaaaattaaaacacacacacagtaaagatccagatttatgcaagtgagagtgaggggctgactatttaccagtcaacagatctccccaaatggttctctgcttggggttgagatgctcctgaccagcagggcttggggagagacattcttgctccccctagagctggctgacccatacccaggggattctgagcaccaggggctgggagcagcatgtaccacgtgtttcccaagagttagtcatgtttgctcctaaaacttattgtaatcgaggaatctaattaaacaatacaccaactgaagaaacagtgcaaaaagaatgagtgactgtttctatgaaaacttagatgaactactttggaaagattcaataaaaagcatgcctaaatacatatactggggccaggagcagtgattcacacttgtaaccccagtgctttgggaggctgaggtgggagggtggcttgaggctaggagtttgaaaccagcctaggcaacatagcaagaccctgtctctacaaaaaaacaaaaatttttcaactggttgtggcagcacctgcctatggtcccagctgctctggaagctgaggtgagaggatcactcgagcccaggagttcaggctgcagtgagccgcaagtgtgccactgcactccaccctgggcaacagagcaagaccctgtctctaaaaaaataaataaaatatgtacatccagatacagtattatgtgtgggcgagacaccggtaaaagatggaaacaatcataaaagtcaggcaggattccacctaagattgtctttagctctcaatctaccttgttttaaaatttttttatgagccataaaagacctaagactagtctttattgtacaacttgatgaattctgatcctgtggccatacagttcaaaatagagcattctagcactcagaaagctccctagtgccctcatcagttggtgcctgtcaaccccaaggatgtcatagtcatttggacacccctggcacagtcattccacttagagactctgccagaagtcccagatcataatcaggagtgaaatttacacaagaaggggccggaagccctagtgagtagtgaactcaactccaaaataaccctacactaaaaataaaactggaacgtactttttatgtttgaaatttaaataagatagatgtatttttgttaaatcgttccaacctgtacaacttttctattcatcagccaactagccagagaaagggggtttctgctgctgtcagagtataaaaatgagctgcaattttcaaaatttgacctcatctaactttctccagctatgccattcctggagcatcctcagtccagtgcctgatgcgtaaaacataataaaaaggtgaccccaccacaccaaacactggggtgtctgtagcagtgaccgcgtctcacggggattttgtctgaatgcctgttcctccactcgcctaatccatggaggtcagggaaccacgcacctcaacacacacagtagcttcttaataaatgttggtccatggaagtcaagtcagcccttaaagggaagggtaggaaacaggtgtgcagggagggaggagtaaagctgccctgggcctgccaggcctggggccaccccgcaggcaactctggagccagacagcctcggggcaccccaggctgagggaaggagctgggcacagccctgtgtccccgtctctcagccaatggaggaggagcttggtcagtccctacaaaggttgcagtggagaccctgcaccagggtacccacctacccatgaaggcacaggaggaacattctggaaatgaggaggcccttgtgaagccacagaggtgtggaacagcatggcacagcacccctgcaattcccataccctgtgaggaccccacagtcctcatctgtccctggatgtagtgcagtggttgtcctcggagtcgctggggtctctgcctgctggctctgccctagtcccgaactggacgccctggctcacagtccctccccacggcaccccctcctgcattccttggctcacccatgagcccctcttgggaatggctccccaactccactgcttcaggaaggagcagcttaatgcttcccgaagcttctccagccccaccccacttacccccatgatgtgagcgcttggacgcaccgtcccagtgacctgcctccacggtaaaagagggcctgaatgggggttcttcagtgcggggatcaggggctgatttcagaatctaacgactgtcattatgccgcatacacagaaaaatgaacacgagagctacaatttacataaaaatcccggatttggggagcccccatagaaccccaagaccaaagacaggtctctcaatgggaaaatttcaggaagcgacgccaggtgtcctaatcctctgaagcccagaatgtgtgtgcaccggggcggggctgccccggagaaggttcaggcgaccttcgcgtgaggactccaggcccctccggagaacattcctgagcctgcaccaactgccctccgttcgctcctctccaaagggtctcagaaaccctcaaaatagtgttaggaaaccatcttactaacgaatgtctgcctcttgctttccaccgtatttaaaactcttccttaagctgatatgaattttgttaaaagcacacggagaatgttttctcattgcctcccactctgagctaggtattccattcccccaaacactcctacatttagtaatgcgaaaaacagtgaaagatctcaaagcccatagatgaaagttaaatcagttctgacagaccccgatgtgtgatgaaatattatgcagccatttaaaatgatggaataatacttgaaatataaaaaagtttaaaatgcaaaccccagaagcatctacagtatatccccaattttctaacacacacgtgcacacacaggcttctaagaaatgattagaaggaaatacaccaatgtattaatattggttatctctggtaagactaaaagtaattttaattttcttttcttctttcctgtattttccatggtaagcatacattgatgttaattttttgattgaaaattctactggctccacggcctgtcttgtgtaatcacagctgagctcactcatcttctgggctttggcaccgtagggaggaaggcagcctttccccagtgtgcccttgggcaatccagatccaccccgagcctgggccctgctgggtactgcccaggcgatgccaggagagggctgagtggtggccgcagctgagtgcagacacatgtggtgcagagcacagcatgatgcagtgtgggacggtgggctttgcaaaccccaggaagggacagcggccaggtgctccgctccaagcccagtcccccaggcctcagtgagcacccccggctgtgacttgggccagccctccattcactcagccactgtctctctgaacatgccctgccctcctgccgggctggctgggctctaggagggggtgtcctgtgcaggaggcacatgtgagctcaagggcacaccaacccctctcactagtcatgagttgggcccagtgcaagcccgctcactcactgctcactcccgccaaggtcaagcttctgaaccccttcttagagacaaggagacctgggcttagccctcgagtccacgtggtcgccaacatgacatgacggagccagggcccccagccctgccccagcctggcccctcctccacactggcttctgtgcctcctgcagggccagcttctcagcagcgcctctctctgcaggaattcactcactcggaagctgggcagactcaacccagagctttggcctcctggacttgggcatgctcctgtgtaatgaggaagggcctcattttaaacaaccagatcttgtgagaaatctttcacgagacagtagcaaggggagggtgctaaaccattagaaactgccccgtgatccaatcacctcccactaggccccagctccagcactggggatgtcagttgagcctgagatttgggtggggacacagatccaaaccgtatcagaagggaagagagccatcccgggagtgggcaggctttcccggtggaccttggggagtcaccccacatctgtgtcagtacagccagacttaacaatggaaagagccaccagaccagttcaggaagctgggcgggagatgcctcaaggagatgaggccagcagtatggagcagcaagtccccctgtgcccccactctggggagctgcaagaatgacctcacaggccctgccttcccccacaccctgtaggctgcgcagctcccccagcaagacatggagctgtcttcccacccctggaattgctggtcatgtgctgtgcctcagccagcagaggtgacagggtgaccttggcctggttccccctgagctcactggctttttttttttgctttaagttctgggatacatgtgcagaacgtgcaggtttgttacatagctatacatgtgccatggtggtttgctgcacctgtcaacccgtcacctaggttttaagcccggcatactttaggtatttgtcctaatgctctccctctcctttcccccaaggtgagcaggtccctggcacagccacacccaaaccaaaggtgcccttggaaaggtcactgtcttcattgctcaggctggtttgagtcaggttcctgtcacttgtaacaaatccactggatttccaagcctccaaccacacctctgcctcaggtccagtgcactgagacccagcccacagctctcatcatgttgcagccccttcaccacttccagcatcatctcattttccaacaggctgaaatccaaatgtgttcactttcgtaatccagtactccccatgacctggtcctaatctgcatctccaccaccattgcccatcattcactagataagcacatgcctactattgcaggcactcagatcgtgaacacatattggatgaagcagcaaagagccctgcccccggggggaagacagacaccaaatggggaacacaataaataagtaaattgtatagtatgtgagaagattgtaagtgctttgacggaaaggaaggaagggagggagggagggagggagggagggagggagggaaaaaaataagagaaagaaagaaaatgtcccctttccaaaaacaagaacgctggcttccaacagcactggtggaatcttgtatttgctcaaccctacaagacagaaaatcattacagaattgctaccttgcaccacagtgaaagcaaacccacaagtcaagttcaatatttgtttgcaggtattttgtctgcaggacaagggttataggtcaaggttccgtgttcaatgttacttgggttagtttctgttgtggtggtggggttggtttgttggtttggtttcttgccttgttttgatttggtttggttttggcgtggtcatgttactatctgaaatacagttagctcatatttcccacatgctgtgataaatgttgttaataagtcagcctctgtggaccagctggattgtgtgttctccctgctaacccagagcacactgaaggcaggtgcttattatcctattcatctttatgtctttaacgccaatcacaatttctgtcatagagtaggtgcacaggaaatatttgttaaattcaaccactgaacctaaagggtttctggaaaacttttttgcaaaatccatgtaaatgccataataaataatttgcctatatattcatagactagcatccaaaccacaagcacttactttatgaataattcagacatatgaagagctgattaatgactcataatttagaaccccacctactgtcccctgggtgggggggccagggctgctctccaatgcctacctcatgccctgtgcagaacacgtgaggctcacccacctccaaacagatgcagtgcgccctctgcctcaggcagggcactccccaacacatgggcagctgctcacacagagatggtattagggccttttggggatttgggaatcttgaacactcatgggaagattgataggcttctgggatgccttccatggagcggctcgggacaaatttgtgaatgcagcggccaaaagatctgcaatccgtcatgggttgagtagagctacccaatgcgccagcagcatagggaaaatgctgaggaaaatgtgacggcaggtgcccactcttaaagcagccacaagtctttactgaggtcctgccgggtcagatcctatgctggatataatagggaaggcgtgcgtttgaaaggatttctcagccgcagacgcaagccacgcatagcgctcggtgagagactggtgtccaggagcatggaccgaggtgcagtggtggggctggacttgagaatgactttcaactgccaggatctggtgaccaaccggatgtcagggacagagagaaaggcccaggtggggaaaactcaaggcttccagtgtgggaggctgctccactcagctggaccccaagggtcctggggaaagggcctatttgacgggcagcagaatgagctgctcagaaaacaggaaagagaagacatcatttcagacctgaggcagcgccgacctatttggaaagaagaaatacacagatgaagcccctaaaatcatttaagtgaaaggaaaataaaatctcaagacccagttcattctgccaaagggaaaagctaagctgggactgaggcatgcaagcctctgcctttccttctgctccagagcaaattgctgcggaaagcaggccaggggtctccacagggagctgctcttatgctgactttatcttatgcaaagatttactgagcacaagacaaatacatgatggatgattcctgtacccgctcctttccaatgcgatgtgtggactcagacatatgaccacaccccctccccttcccctcctgcctgctttgcccctttcagtattaaagccctcaaaatcctctttggaaaaattggatctcaggttgttcctgtggtttcctgttccttttccccaggcacatcctgaatgttggcagaataaacctctgagttgattgaggcctgtctctgccactttttggtttacaactataaagggtgactgcataagggctgagataaatgacaagaaatgtattggaaagacatggtattcatcctggaagccttcctgcagttggggagactcaagccaggctttaaagaacatgaggggtgaccagaagaatatccccaaatgagaaggcaaatactcagaaacacaaacctctcgattagaaattctgttttaagataaagcactggtggaggggggacagagagacagaaccagagagggacagaaagaaagggagggagagaggaagggagagaaatagacacagaggaaagaagaaaggaggagaaaagagagggagagtaagagcggggagagagaagaggaaggagaaacgtttcattttgcttggggacagagcacttaggaaaacaattgaaatctgtccaggaagcgcctttctattttctttctgcttctaagtaaataatctaaagcctcatgtcaagttgtttgcatagctctagtagctaaggttagtttatttaattaaagtgatgatttcaggccaccaccaggagtgaattagaactgtctcctcgctgctctccaaaaccccatcaaggtgactctctccgcccgaccctggaggctatttttatcctcttgatcttggtgtgattagtaaaggcaattaagcagccggatcaaagctcagggcctcacgccttttagatgttccttaacaaccctggcagggtttgcaggaataagcccgtgtggaggcaagcatgggcatgaataaagatcacctgagaaggcggagggctgctggggagacggtagcaggaggccatccagggaggggctgggaggcagggatgccccatcctactgctctggggtgcctgtcccattctgtgccctgtgcatgtgcctcctcctaagaagatgaattctttggggtttataaagaacctctctcttctgtcttaattcagtgagagacacgccccttctgctgtcctgcagccataaattgaaggcccctgcaggcccctgaggcctaccctaaattttgctgtggtcttaaaaaataaaggtgttctacattttaaaaaaaagaattcctgagacacaaggaccagtcagtatttataggctacaaaacaaataaaccgggttaacttcattttcccattgaacctgtgtgaggggcatagaggggtcagggttcaatcaggcttcccacagcagggcagctcccaggaagagaggttgaacctgaaagagcgcacagacaggcggggaccgcgctcttgcccaggcctacagctggtgggcaccagaccctgggctcggacccctggttcgatgccgtgtgatgttgcactggctgccccgcagctgatgcagcggggaaggaacgggactgaggagcagtggcatttggaagtcagagtttccacaagcaccagttaagtgcatggatttctctcccagggatttccttcttcccagaccttggggccttcatctccagcctctcagaaggaataaattctcagaaatacaggatccacacacatagcctgccagaagcctgtgccactgcgtaagtgtgagtgactacggaagacaaggtggactccaaacccgacgctatgatccactcgagcctcgtccagggaatttatggagcacgtgggacctccctgccatccagaagcacagaggaggtgcgtccccacaacaatgccaggaacacacagcggggaattctctgacatcgagaggcttccagtgaggggcactggctgccctggaggtgacagagactccacatcagctacctgctgagatggtgctgggagcctcgtggagcagagcagccgatccgatccagggtacctgctacaggcctggcaccacctggtaggtcattgcgggaggacttgttcaggctctgatgaccctgtcagacagagagacagagagtccgagagaaacagagacacagagaaacagagaagcagagacagagacagaccaacggaggaagagaaaaatacagagagagacagagatagagagaagcagagacagaccgagagaaaaaaatacagagagacagggacagagacagaatcagagtgagacagagagaacaagggaaagacccggagagagaaatgcagagaaagaaagagacagagacagagagatacaaagagacagagacagaaatagagagacacgcgtgtctcccaggccgccgtcccgcccagttctaggcctggctgcagtcctgcccccggtgcccagagagcccttctcccatcacgggccatctccactgagccatgtgctaagcatcagctcctgggagccacggtgtcccctcacacctgcagtgaggactgagaaagctgcagatgggaggcgaggcagcgacacagccggctggcactaggcatggggtgacaaggtgcatggcgcggccaggacagccttgtgcaggggacagcggaagctcaggagacaaggtcagaggtggtggggccccgccacggagggcaccgaggggaggaactggggcttcattttgcggaatgagagtggaggccatgaaaccgaacctcatgcacccccagccacagcagcctcatcaacggccccgctgctgccgcgggaatcgcccacactacccacaggctccccaccagccctgggtgcaggagacactgaggtaggtcctgtcctgggaggtgtgggagcctgctgagggctggctttggcgggagctccagcccatgggggaacagtggccagcgctgggaagtaaagatcccccacgcctaggctggccagtttccatgggggcagcacagcccacctcacgtctccagtggctcacactcggaacgtttgccagcctgctctgctgagcggtgtgagccacctgagtggccccagcacctcccagctgatgcccccacctgcagcccccaggacgcacccccactcctgcaggctcagaccccactgcagcctgggctcccagccgccgccagtgctcacacgttttctcctgcaggtgtttttcccaataaaatctgtgcatctctcatcctgtcttggtgtctgcttctcgggagacacagagtctcacacgggaaacgtgttgtcagctgtgaggggtgggtgggggtggagataattgccatgagccatgccagggcctgagaaaggaaacagacacagagaaacagagaagcagaggcagagacagaccaatggagggagagaaaaatagagagagacagagagagagaagcagagacagaccgagagagaaaaaaatacagaaagacagggacagagacaggtggcgccctgcaggaggaggtggcagctgggtggagaatcagcaggggcggcggcatggcaagcccacctctctcccagggttcgcgaccgtgatctgctgacaggttggacaggcactggcaggtcactaccaagacgttagatgctgcaaagcacaaggcactcctcataagaacgcagtagtaattagaggtcctgtgtgggaacagtgccattcattaacagtgatcaccgtttgatatcgacagggtccgaccaacgtgcccgcaggatgcagaaagggcgcgtgatgagcacaggagagtttagagtggccccgcgcctgcttcccaagctccagagacactttctgcagcagccgcactcctgacaaatgggattttgggggaatcaagtgtgattttgattcactcggggagctcaccacttagaagaacgctgcggtttcaaccagtccttcagaaatgcagagagtgtgggaattccaatgaaaaggccctgaggagggcgtgcggttacggggtcccttgagcttgataaaggtaaggacaagggacaaaagcgcaggcagaggctgcgtgggggatcggagtgggggctgtggcctcggtacacagaggaggaagagctcagcagagtgagtccatgtccacagcctgctccgaagatcagggcagtgacccctggggaagaggattttgaaagatttggagggaagggctggttgcatgacaaagaagcggcaggaagaggttacaggtcctgtcggagccgcgttgcctctgcaaggctgggcgctggagaattctgcgctgggtggagtgagcatggtgacccagggctcaggccactgtcctggggctggaggcggccacagggggctgttgtcttgggccccccgctgctcactgctcctaaggagactgagtgtctctcgccccacacatctctgtctggacaaggaatttgcccaagggacctccctgagtccggagggaagaagggagaaaagttctgaccccagccctgccccccaccttccagccctgtcctaggtctgccagctgagctgtcccagcaccgtgccccgaggccctagagcacatgcgggcgaccagcactaagttagaggaccaacaactcagtggcacactgcctttcccccaccctggcctcctgatggggaagacaagaataagtaatcatgtttgctcacttccaccagggctggtgagaagctcaggaaagccaggggtggtgagcaatgtctggaggaggcgatgctgtggcagctgttcccgcatggcagctggccgtgtctccctcctcccatggggcccgtcagtgagcaccgtcccaagaaagaggacaaggcacctaggccagccaaggggggaggggagagcaatgaatcagggcctcctggagcccggaagggctgaggccacagcagtcctggagccctacatggcggggatgtcaggctaagggcagacatgatctaaaaaacgaaaagtggaagaagaaagaaaaccacgaggtgagcttccagaggctgggaatacgccactcctgataataacaataacaccaaccaccagcagcacatgtgcacacatggcacgtcccactctccaagctcctcacatgtgaagttccttcttccaaagccccagtctcattctgctcaagctgccatgggaaagtacgtcggacggggtggcttatgcagcagacgcctgggagtccaagatcaaggcgtcagcagggctggcgtggtgagggctctgcctgaggctgcgggggcacctcctgcctgtgtcctcacctggcctttcctctgcccacaggagagaagcaagcaatggtgtctctttcactccttataaagacacgactctacagggttgggcctcccctgtggcctcacttaagcttcatcccctccctacacaccctgtctccatgtgcagtcacaccgggttaggcctcagcataagagtattgggggcatgcagtccaacctctaacagcccattggagagaggcacaatcctattattcagccccttttacaggtgagggcctgaggcccaagaagttctttcttacctaagtaagtggcagagccagaactccaactaaggcagtttctctgttaaaaataaatagtttataatctccagaagagcggcctgtcatggcaagaggtaggtgtcagtttggctcagaagggagaggtcctgtgttgatcttcctgtcccacttctcgcattttccagccttcctgtctttgctagggcagctccctcctgctagaaggttcttctcgatcatctcttttcccattaaaatctcatcatctttcaagaccagctcaagtgctgcctcctccaagaagtcctcctgatcactcctggcagaagtcgcctcctctatctctcagagcgtattccatcacaacgttcccacctggagagtggaattctgtacatatggatggagaagcacttgttatgctgggagatgagacgcttcacgagctacctgcctgctagattgcatgttgtctcctgacctcaagagcttgttttatgtgcagaacactagacgtctgatgatgcgaacaccgctggaaccctcattctgttagacggcaggcccgaagagcacacgccaaagttggtggcctaatcctcttggcatctgttatagtaaatgcattttcatgggaacacagccaggcccatttgcccaggtatcacccacggctgcttctgcactacaacagcagagttgcacagccacaaaccctaaaatattcactgtctggccctttcctcatatttacccgcccctgccccaaaccctccaccacgcggacctgattccatgcttctggctccccaggagcgaagccgtagatggtgtctctttcactccttataaagatacaattatacagggtaggggcccctccctgtgacctcacttagctcccagctgacccaatcagctcgcctcctccactgagggaaccctgccattctcggaggagggagtgtcgtctgaccaatacgctgaggaatgccagctgtccacaggctgccatctgatccctcactcacagaggaatcctttgtggaggtcagagtcattgatcatcataaaaacagtcacattcttgtgatcttggcagtgcctcacgaaacacaacctacaccacatcactcttgaatgttgtctcatagaaacttgtggacggattttattctgtattaaaaatgataaaatggaaggtgtggcatgttacataactctgcatcagctgcagaccatcactttctttctttttttttgagacggagtctcgctgtgttgcccaggctggagtgcagtggcacagtcttagctcactgcaacctctgcctcctgggttcaagtgattctcctgcctcagcctcccgagtagctaggattacaggcatgtgccaccatgcccagctaattttcatatttttagtagagacagggttttgccatgttggccaggctggtctcgaactgctgacctcaggtgatccacccaccttggcctcccaaagtgctgggattacaggcgtgagccacctcgcccggcccagaccatcactttcatgtgtggttgccaaaaagcctcagtcgaaaagaacatgtagatttacctaaaggcccaggaaaggggcctgttgaggtgaatgatgatgggcctcccaagggatggtccaccgtgcagccgttacaaatcatgctggggaagggaattatgtatgaatcttaggtggaaaaggttagaaaagatcctatctaccaggaaaagaaagaaaacgtggacttaataaggtcattatgccgagcaggggctttgggaatgtgcttgatcccttcacggctctagaacagctattccgccccagactcccatcacaaaaaccgcattcggggtctgttgcccgcagcacccacagttatcccgccccagactcccatcacaaaaaccgcatttggcatctgttgcctgcagcaccccatggatcaccacacacggctgtttcttacattggctcaagtttcagggatgagtgtgggcatgagtgccacggggaacgaggtgtgctcgagcctcctgagcactacctgaaggagacagaccgaccagtcctcccaggtttccgtctcggcagcggccgtccatccggctggcccgtccatgcccatgcccatgcccatgcccatgtactggcgattccaaagcttcattttacgtgaaaatcacaggggaaaagtgcagcttccctggcccctgttaccagggactctgattctgagggaccagactgggagtaggttccttccttaacaagtcctccgggattcagacgctggtggcccagaggccacccaagagacactgccgggagccgggcgggttcccccacatggcaggccagaggtctcactctgcacacatctctcctttctgctgttagagtcattcttttgtggaaacagcggcctgggctggtccccatcactgagacagaatccataggctcagatgaggcctaaacaatgatacaccagtctcatccactccacagcaccgaattttctgagatttaacgagagccgactcactgggaatatctccggagcaaggaattaaacgcctgaccagagcctcaaagtggaggacagaggcctccacccctggctgcccactgcagctgcttcggccaagtcatgcgacatttctgtcttgaccagtggaaacccatgcagttgttccctgtggtcgagggaacaatggccccagagacatccacgtctggatccctggaatgcgagcctgtgtcaggttccatggcagaggatgatggttgctcatcggtggccttgagacgagagattctcctggatcatccagtgggtgaatgtcatcccaggtgcttctggtgaggaggaagggagaggagtcggaggaagggctgcgctgccagatacagtcagagagatgctgctgcagctgcaagacagaagggcccaagcccagtgaggtggccatcctccaacctggaaaaggcaagaaaacgggggctcccctggagtccccagaaggatgcagtgtgctgacacctggccgtagcccagtgagacccgtagtggacctttgaaccacagaactctcggataataaatttgtgttgtcttaagccattaagtttgtggtaatttaccataatagcagcaaaagaaaactcccacagcccttgcccacttgaggacctgctgcaaagctgggaagaggaaggaggcaggaggcttcgctccgtccgtcctttctgttttagggcctgcacattttgttgttccttcttgatttctatccttaatgatcacagtgatttggggtaatatgagcatcaaagtgcttttttgctgaagacctgtttgcttgttgccagttttatagtgacccaatagaataagaccagtaaatttattgatggcagaaattagccatgtccttaaacgctttcacagggcagacagagacgtcttagtcttcgtggtggagttgagaccgaggcagtatcttcaaaggtgtattaaggtgcctttgttgtcggctttcaacgcctcctttgaaggactcgctcacttccccggcaggtgagtaagcagctcacagggaccccgtgagcaaagcctgcaaggggcagagccaggctgcaaacccaggccctgcacacggctctcacgcttctgtcacaccacacccagagcatcagtgcctctaatcaaccaacatttcagttcctacggttcaaaatgggccttacaggacttcaaagcatcgataattcagacatttgcttggtaaatcctctatcatggaatatgatgaaggcaacttcagatcaacaaactggtgtctgaattatcacacattctgaaatcagagacgtccagtgaaaagagatttgtctagtaaaagtaattccagatgtgtaacccaaaggactcgtctaggaagttccagtgggaaggactttgctgctctccagcacgagttattttctcccaggactttttcagcctgccagccgtacacttcccagacatttcaccaaatgaagagagaaaggaaaacaaacaaacgaaaagctttctttaagtagctttgaactttgcactagacagatccaaattcattggcttctgcactaaagctgtctccaagacatccctgttaggttcgtaactaaatcgcccactaatatttatgctctgtcttaaacaaaggaaataggagctgttgtcaaggacacggtggggcaggcaaggcgagccggtttctggtgcagacacagcccagagacaagcttcaaaaggacagctctgcctgggccctcagagacgcgcagctgcgtcagcgtggactctgggtggtgccggattgtggataatttgagggaatgcacagcacattaaggaggctgggaatgccgagggtctggtgggccagggtctctgagcccgacgtcctctcagccaccgttcagcctgacccaggacaggcctccaccctcccatgcgctcgacttctcactcagcagagacacgcagcttcagccagtgcagcagcaccacgcagcttcagccagtgggcagcacgtgggcagcaggaccacgtgcccaccagatgcctagtgtggtacgtcttggtcataaattagatccttaaacaaaaatgtaagtatacaaaaccacggcctcaccccaaaacgcccagaaggcaaacacactctcagccgaatggccttctgaccgagagcccttttgcggctgttaccccatttgatgtttagaacaatcccaagaggcagctgtggcatgggcatcagtcagggctccactggagggcactgaaccacaaggaaccagggccagggcctcaaccatccagcaaggtggccttgggggaacacacgaggatgacagccgggagacttcagtccaagtctctgctctgtcccttcatccccagacctggcttttcttatctgtaaaatacatggagggcctgcggtggtgtagacacagcatgagaacactgcttctcaagttttattgcatgttttttaaaaggcaatatcccagaccctatgtccagcgttttgttttgttttgttttgctttttgacagagtctcactctgtcgcccaggctggagtgcagtggcctgatctcggctcactgcaagctccacctcccaggttcacaccattctcctgcctcagcctcccgagtagttgggactacaggcgcccgccaccaagcccggctattttttttggattttttagtggagacggggtttcaccgtgttagccaggatggtctcgatctcctgacctcgtgatccacccgcctcggcctccccaagtgctgggattacaggcgtgagccaccgcgcccagccatccaagggttttgatgactatttctgagatgaaacctagaaatccatattttagcaagcttctaggcacttctgacacaggtggttcagactactgtcaaaacctggaaactttggagagcaaaagtgaggtgattaatgattaaactggggcaacagcatagcctgaggctgacgtgggcaagtttcaatggaaggtcacgcgagggccggccatgctttcggaagacgttcctctgtgtcattggaggagcagcgttggctgatctggtcagggattgcactcatgcctgtcataaacatcagaagagggtttactgtcagctgtggattaaaactcaaaggccagagatcaggctactgttcttcttccccatgagtgcaaatgcttttcccctgcatcagttggctccaataggctgattcttttaagggtcaaagtcccacactctcctttttattattaccctgtttcctaaacgaataagaagcaacagcacatttgagtcaccttttatcatcctaagatgccgctctttagtttctctttggggcacagccaaccgtgtccaatatccattctgcctgtcctcctcagtaaggaaaaaccgagtttgagctctctctgtggccatctggaatcaagattctgtttcccagctcctcatgcagtgaattgtggccacgtcgaagttcaggacatgggatggaagtagacttggcctgggcaccttcttggaagtgctccaaaagagaagggcataatctttcttgccctccttcctccctgttggctagaataggaatgtaagagctggcaccctggcagctctcctgggctatgagcaaccttgggaatggaatccaagcacagtggaacagagggctaaggaggaacccagttccctgccccaggggcacgtttcagccaaggatgtaatgtttccaggcctcctagctgtgacagagaagtcttatatcctttacacaatgctgttagttggaattatcctttgcttgctgtcataactaattctgacagacacaccttgcctgttccctcttctgtcagccaaggctggggaacagaacagaaaatcacgatgccgctgcgggagcaagagataccagggtggtcacgggaagagatccaccggggcaggttcccagaattccttttctccaccataattccacgcatcagccattgtatgaggcatctgtcatataagctcagtcactggagatgaaggcacttcacaaattcaacgccttttgcaaatgtacccactgtctctctcaacagctgtgctaggtggcccggcagggacagtaaatgcactgggcgctgagatgaagctccctgttcaccattggcgggcacgtgctcggtgtttcactgtgcgtggagaatgccaggctgccatgtaagcatctgaaggaggcaaagcgactctaccctatcacctccgggtccagcatcactgaggatccccccaagtgtggctcctgtggtgacacccagactcaccacctcaaacgaccccacctctgaaaccatcagctctaacttcacctccgtgcttctaggcccaccgaggcccctagcaccccctcagcccactctagcttcacttcctctccagcctttcccagagtccccggcccagcaccgagggctctcctgcaccctgccctgtgcacatctccatgccacacaggtctgttccggcacctgcccgcctgccaccgccttaccctggtgttcccagaactcctagagaaagcttcagtcacaagggtgccactgccatccctgctccagcccagggctcacggcgcccagcagtgctgctgccatcctcagagagctgttctgccctcctgccccaggctgccaggcctctgcccacttcagctggagcaacagggcttcccctggtgcacagagctaacgagaaagccagagtgaatcccacattcagccttcctacgcctctctctgtccctatgtctacctctgtctctctgtctctatctctctctgtccctctctgtctctgtccctctctctttctctcttgcttgctctgtctctctgtctctgtgtctgtttctgtctctgcctgtctctctgtctctctgtctctgtctctcacacacccctccactccaccctatctgtgcccctcgcccctcagtggcccgggcccccctcttcttctgcttgtagccaccccctcctaccagctgggtcctgccccatttcctccaggcccttggtccattgattctcttttaactctagcctatccctttcaatttattatttttaataagcagagaaagattcccaagactttaatcttaaaaagaaaagaaaagaaaaaattctaacctagaaacacatccccctaaatgtggccctgtgactccctcccagctcaggcagccaatcctccagaaactcccctcaagggctggcttcctcccgtctctgatttcctgtccctgcaaatcttccccccaagggagccagggtgctgctgggcacctctctaatgtgccttctcggtggcatgagacacagccaggcaccctccctgagggcggtctcctctatgactgagtctctctggcttcttgtcctgttttgccacctgctctcctcctggctctgtcttcactgattccctgaaagcagagcctgagcccgagcttctctctgctgcccactggggagtcccaaggaggggtggggaaggccaggaggctgattaggcaagtatgcagagtcggggtccccaaccggccactgagggctccaaacacagctggctgtgccctctcacagggctgagagcccccatgagctactgaggcccaaggtggcccatcaaaaggacaaagggaggagagctcctcaccatccttagtccaaggcccactcctgggactcttcagtagcaccactgaagagtgctgggtgcatcccaaatccgcagcagcagtgagcacggggcagaagcagccagcacctggggcctgaggcacatactgtgtgctgtgccccagggctcccaagaccagatcacctcggtggtgtctggggtgacttgcggggccaagagtccaggagacaagtgaaggctgaaagggcccagggcagggccaaggggtgtctccccatgaatagtaacaggcccaggccctgcccccgttcttcctgcccatgctagtctctcagctccacattcatatgtgccatccacagagacctcagcttcacatgtcagaaactaggctcaggacggtggttcccacaaaacttagaaacagaagtgtcaaaactagctcggtcggggagaccctaacccagcggtgctggaggaattaaagacatactcacagaaatatagacgtgggaagtgggaaatcaggggtttcacagccttcagagctgagaggcccgaacagagatttacccacgtgtttattaacagcaaaccagtcatcagcattgtttctatagatgttaaattaactaaaagtatcccttacgggaaacgaagggatggaccgaattaaaggaataggttgggctagttaactgcagcaggagcatgtccttaagtcacagatcactcatgctattgtttggcttaagaatgcctttaagcggttttccaccctgggtgggccaggtgttcctcgccctcatccctgtaaacccacaaccttccagcctgggcattaggggccattatgaacatgttacagtgctgcagagattttgtttatggccagtccagttttggggccagtttatggccagtccagttttggggccagtttatggccagattttggggggcctgctcccaatatgtcccccttctctgatttgcaaatcgataaaagcaaaggcagctttgtcacggtgagctacttcttgcaggagtcaggatccacatctgcagactatacaaagacaaacaacacagattaaaagcacaatcatctttgaaatcacagagcttccaagtgttttttctccattttcagctcctttgagcactccaggttctggaattaaggtcaggtgtgcctgggatgctttaaatatttgttcttttcattttaaatccttatgttaagctcctagagcagcccatatcatttgaggttgaggtgccactataccgccatggttccagataataggaactcttgccgtacttcttaccatttctaccatctgaccgttttgttcagatcatctgaacatagtgtggccgtggcacgcagactgagaggtgcagttcaagctaaacatccccttgggggaccaattaataatgattccgcaggaatcgttgtgcagcacctctgcctgttctgcaatgcaatcttccaaacaagtacgctcattttttctaactggttccaatcctgtttacaaataggtttttgagggtggtgtgtgtcaattataagagcagatttattatggtgaatactgagatcagaaagcatgtgtaactgtcagagtgattgcatccagtcattattgccagccaagatggataaataagtagaactgttctctgtgtaagcccttattgaaggaatactcacggcggtggtgataaccgctatcagagctatcattaaattattcattgtgactggttgtcccgctttcctcaggttttcttccgccatctgtgacagcttcctgttctgtccccaggtgggtggctgtgttcgatgggtgttgctcgtgacagttggggtcctccgcagcgtcagtcttgacatggctgcaaccgggggtcctcgggatcctcctggaatctcttcctctgcatctggctcatgataaggtttcaggtgtcttgatggtatccaaatcggctgttgattttggcctggagaaacacaagcataacctctaccccaagttattattttacctatttcccaacgttttgtaattggatctctccaccaaaccagttgttccgcttttgtctttgcagctggtttctgtaaatgctgttcagctgctgataacatctggtctttgggcaggctcaaaaaatttaaagttaataatgctaggttcagttgcatctatggggttccatatactctgtctccccctttctgcttttgcaactgctgttttagggaaagatacattctttccactatggcttgtccttgagaattgtatgggataccagtaatgtgtttaatattccacaaagagaaaaatgtagctagagtttggctaggatagcctggggcattatctgttttaatagaagctggaatgcccatcactgcaaaacactgcaagaggtgacatttaacacaggcagaaggctctcctgattggcctgtagcccaaagtgagaaaaggtgtccacacatacatgtacataagctagtctcccaaacgagggaagatgtgtgacatccatttgccaaacagagttaggttccaatcctcgaggattaactcctcctgtaaaagatgaagaatgggccatttggcaagttgggcatcgctggataatagctttagcttctttccaggtaatactgcatctgcgtttgagaccagaggcattcacatgggttaaattgtgaaagtgtctagcatttgagattgcattagcaattaggcggtcagccatttgattcccttcagccaaaggtcctggaaaaggtgtacgagacctaatgtgagtgatgtaaaaagggtgcattctacttctaactgctcttggcagttgggtaaataaagtcatcagttgttcatctgtatgaaatcgtaactgagcactttcaattaactgtgtggaatgaaccacgtatgaagaatcagaaatcacattaataggcatatcaaaagcagtcaatacctcaattacagctacaagctctgctttttgagctgaagtatagggcatctggaaaactttacttttcgagccagaataggaagctttaccattactagacccatctgtgaaacaatgaaaatgcttagcaggctgcaggttgtttactgcaggaattgtaaatgcaaacccttcacagtcttgctcagctaaagagatagtaaagaaactgtcttttaaatctatgactattaaaggccaattttttggaattatagtaggagaaggcaatcctggctgtaatgctcccataggttgtgtaactgaattaatggctcttaagtcagttaacattctccatttacctgattttttcttagttaggaaaactggagaattccaaggggaaaatgttggagctatgtgcccattttctaattgttcggtaactaatttctctaaagcctccagtttctctttgcttagcggccactgttctatccaaattggcttatctgttaaccattttaaaggtataggttctggaggcttaacaatggccaccatcaaaaatgatatcctaatctttggcgggaactttgtttttccacttgaagcggttccttcaaaccttgcaaattttttcctgttcccatgccagggacataccccatttcatgcatcatatgttgactttgagggctatataattgttctggaattagaacttgtgttccccattgttgtaataaatcccttccccataaatttataggtacagaagttataattggttgaatagtcccagattgtccatcgggcccttcacaatgcaaaacataactactttgatatacttcaggggctttaccaactccaactatgttaaattgagtgggtggaattggccacgcagacggccagtgctgtagagaaaggattgaaatgtccgctcctgtatctaccaaacctttaaatttctttccctgaatagttatttcacaggtaggacgtttatcagtaatttgatttacccaataagccgcgttgccttgtttatttgtgcttccaaatccacctgtttgtttaatttcacttttccccattttcacatacggcaaaattaggagctgtgctatgcgctctcctggctttgctttccagggaacagaagtagatataacaatttgaatttccccattgtaatctgaatcaatgactcctgtatgtatttgtaccccttttaaacttaaactaggccttcctaaaactaatcctattgtccccgctggcaagggtccacagactcctgttgggaccttttgcaggggttccccaggcagaagactcacagcttttgtgcagcataaatctactgcggcactaccggctgtggcgggggacagacattgtacagggttgagagaatggcctgagctggaaatgccccggtttagaatggagcctgggacgggcccctcatagcatttcctgaaatcgagttcccttctttatcaaacttagagtgacactcattagcccaatgttttccttttttacattttggacctatttcaggatcagcagttttctttttcccctatctggcagactgacttgctgattttttctacattcttttttagtatgaccatgcttcccacagttaaaacaagctccaggaaatggagtattttccttatccactctcagtcctgccattgcctgtgccatcaaagtagctttatgcagattacctccaataccatcacaggccttgatataatcaactaaatgtgctttctctctgataggtcacagagcagcctggcaatcgggattagcattgtcgaaagctaataactgcagcactatatcctgagcagccgaatctgcaatcatcttttcaagagactcctgtaaccgagctataaaatcaacatatggttttcttggtccctgttttatagcactaaaggaagggtattgtttcccacctgaagtgattttttccccagctctaatgcacactcctctaaggtgttctatggcatcatcctgcatgaccagttatgcatcgaaaccagcccagccgccaacccctaaaagctggtctgcagctatattaattcgaggttgggcctgggcattgtgagcagcctgaatggaagcttcatctgcccacgaagttttaaattgtaagaaatgagcaggagttagacaagctcaagtaagagcgtcctcatcagtaggaatcatcctattggaaacagcaacattctttaactgtcccattaccaaaggagaacctggtccatactgatttatagcttgtttaaattctttgagtaatttaaaaggaaaaggctcaaatgtagctatatttcccattgatctggggggtgtattctaacagggaactgccaagcctcgaaatcaccctctcatttagcttgctgaattcctgcctgaatagaactaagagtggtcactcaaggcactgctcaaacagtcactggggcaactacttttcgcccagtgtcctccagaaaagaaagatctggagggtctttttcttcaaagtagtaaggagggagtgcagaagggtagggatgaacctctccttcctttgctgctttagctttagctggtaaataaacatgctctgtaaccccttctgttacttcactatactctccttcctcatcatcagtgtgaaaaagttccaaggtgaaacgaaccagaccccacatctgtcccattgttaccctgatgcttctgagctccccttcttactcaccacagggattgctttaagagtactcgagtgtcctccagctagttttccactccaaccattgttctggcaacccttcgacctggatttgagtccccacgatggacgccacttgctgagaccagctaggtcagggagaccctaacccagcagtactagaggaattaaagacacacacacagaaatatagaggtgtgagttgggaaatcaggggtctcacagccttcagagctgagagccctgaacagagatttacccatgtatttattaacagcaaaccagtcattagcattgtttctatagatgttaaattaactaatagtatcccttatgggaaacgaagggatgggtcaaattaaaggaacaggctgggctagttaactgcagcaggagcacgtccttaaggcagaaatcgctcatgctattgtttgtggcttaagaatgcctttaagtggttttccaccctgggcgggccaagtgttccttgccctcatccccgtaaatagacaagcttctagcttgggctttagggccattatgaacatgtcacagtgctgcagagattttgtttatggccagttttggggccagtttatggccagattttggggggcctgctcccaacacagaagtgccatgtgacccctcagttccacttctgggtctatcccccaaaggactgaaagcagggactcgaggagtatgcccagccatgtcacagcagcaccatccacagcagccaagggtggaggcaacccacatgtccatcagccaatgaggaataaacacagtgtgccccacccacgtggaacaacggattattcagccttaaaaaggaaggaaattcggacacacagcacaacacggaagaggcttggagttgttacaccgagtggagggaaccagccacgggactagcactgtgtaatcccactacgggcccctggaacagtcaacccatggagacaggaagtagaggggtgggtgtcagggtgggtgtcagggctggcagagaggaatggggagctagtgttgaagcaggacagggcttactttggcgacgagaaagccctagagagccagtgcagaacaatgcaagtatactcaactgtagagctgaaaatgattcagatgggaaattttctcatgtgtattttaccaaaaatcttaaaaaacaaagctgcactcatctctccctccagacttgccccttctccgcatgtctcactcttggatggcacctccatgctcctagtggccaggccaggggtgggccatcctgactcactgccacccagctggtcccaagtcctgcatctccaccccagcggctgcagtcctcccccatccccagcgcagcacccttccctcctcacccagatcacccaaaagcttcccagcagtttccagcttcttgtctgttgccatccgtgtagttaccccagccatctataactttctaacggttacatcttaccatataattattttctgtttaaagccctcctgcagccctcgatggcctcaggatcaagttcaaaccctcagcagggcccaaggcctctccatccctccctctgcaggcccagctcctggatgctccctcctctcacccatcccaggggccggcactattctgccatctgcgtagagtgccacccctgcctgcatcagctcatcctcaaaagcatctctgttcttagggagagaacatccccagcccattgcctctgcaggtctgggtaagctcatgatgtcctctgcccgcctccatcatgggggctaatttgccttctataatgaggcctgagagggagggccccatccgtccatttaagctttggacacttggaggctgaagcagtgagggggtgagccccattttctcacccactctgaaagtgcaggatgagccctcaaatccaaaggcccgggcatagccaggtgtctccttggaagtaaagatctttttcatgtgacttaaaagaaaattacaaggcttcagagacctaatgtgctcctaaaatgtgaaagccactcttgataataagccttaagaaagctcgctcatttatgaagccaaaggaaaagaatggaatttaaaagatctgtgggtagagctcttttgaaaaccttgatgtattagtccattctcacactgctaggaagaaattcccaagatagggtagtttataaaggaaagaggcttaactgactcacagttctgcagggctgggaaggcctcaggaaacttacgatcatgacggaaggggaagcaaacatatccttcttcacgtggtggcagcaagaaatgcagagcgaatgaggggaaagcgccttataaaaccatcagatctcgtgagaactcactcagtatcatgagaacagcatgagggtatctgcccccatgattcaattaccttccactgggtccttcccaccatgcgtggggattatgggaactagagttcaagatgagatttgggtggggacaccactaaaccatctcattcaatgagaagggaaaaaagtgaatgatgttatttaggtatctgttcatgtatttaacgagcatgtgttgagcaccaagtgtatgccaggaacagaggctcctgcaggcagtttcctgatttcaggcactaatgacgtgacttgtttcagcacaaatttatcaaaggcttctgtgttctgatcacctgggtgtagaacaacactcaaggcaaagtcattgctttcgtagttttgagtttttatccgctaaggaagtatgacaatataaaataagatttagtaaataatttcattcaattgcagatggtaatcagtggtgtggaagaaaaaaataaggtgaggtgagtgcgtgagcgggtgggagaccctcactgagtaaatggctttggagctagctagaatcaaataatgtgaataaagccatttttaatggcagggaacgagggttctaggcagagggaaacccacatgcacaggcgatgccaaccttgtcacgtctggggagcaggtggggctgcgtggtgtgggcccatcgcccacgccgaggctttgggatttgttctggggaagctgggaggccaagagagagcttggggcttagggcagagcagtgttaggccctgatttgtgttccaagctcactggctgctctgtgcaatagaggacgggaacggctgcagcagggagcccaccagaggctgtctgcacactccaggtgagagtgatgcccaggggcttagcacggcgaggagaggccccatccaggtgtgttttgaagaaagagacagtcctgctgcttggtttggatatgcagcatgggggggcattgaagagtaaataaatgatgcttttcaggtgctgcctgagcaactgggcaaaaggcagtgccatttacttggacatgagaacctagggaaagtcgggcttctgttttgtacagttgaagaggcctttggatatcaagtggagacgcaccgttagttacagagtcaagtccggagttccaggcttgtagactgcagacgctgcgaaagatggcattgaagccttggaaaagacaagagtgtgtggagggagtgtgatcgctggacacccttccgcagggcgtaggaacacaggcccctggcagttgcagatgcacagaaatgatggtattggaactgggtcaagaagaacacgagatctttagcaagtggagttgcgacaaggtgctgcgggcagatggaaggctaagcggaggcgggacgaataagatgtatattccacgtgtaaaatatctggaagcttagcatgactggaatgttccggagagacctaagggatgtatgcccccctagggagtgtcaccttgattccacagccagtggagtaccagggacatcttcagttttgtttcttaattgacacagagcatggtggacctgttagcatcttgttcaaagattgccagttacatgttgactcttgctcaaagaggaacgcacacaggcacatgtactgcacaccccagaatcttcagcatagtgtgaatcctgtgaagtgaagctctctgtctttgggttaaatatctgcctttaggagatttaaatgctgagtcacagtcgtgaaattcttgactcgattatatggaattgacttatatgaggcatctggaaatttcttttgagaggtcagtagcagaaaaataaaaaagcattctctgtttcccatgattcataaacccattagcaattctctgtaaactgctcagaaaccagagatgagcagtgagttcctgagccacccagcgaggggctgaggggctcaggacaccttcccaggcccagctccaatctggggtgaggctcccggacaggggcccttcctctccatctcctcagtggtcccctgtcctcagggccacgttgggactgccccatgctggggctgtcccgcaggctggcccgggtgctattcacctgctcaccctcacagctcagcagcatgtgctgccttatgacatcaatgtctctgtcccatggggcctcacagagctccccaagaactccgtgtttcccgatgaagggatcaaagacccagaaaagtgactggcagtccagggccccagatgtcctcagctcagggctggacacccggtgctgcctgggctctgtgtccatccataagcacgtcccagaccctcttacctgccaggggccctctttgtgggggaccctacaggcaggacagtcgggaaggttcctgccttcaggcagcttctcgcatagtgggaagacagaccagaaaagaaaagaaacacacagtgaggcctcagaactgtgggcatagggagaatgtgcgtccctgagggcatctcacctggctctggagaccctgtgcatggggcagcttctctgaggggacatgattgaaactaggccaggacgacaaatctgaccagagcccagggttggaagaggtggtgagcaacgaggctggagacactgagcccagctgctctgggtctctcgcagacctgatatagcagggacacagtgtccatgcccaaggtgccggtgctccgtgaggatggctggcccactatggacatctcccgagcctgccgtgtgcttcacagggtgaggatagggcttcaggggtcgcacacatcagctcagcctccataacaacgtcccacagactggggactcacacaagaagttcattctctcatgttctggaggctggaagttcaagaccaagtctagcagggttgctgccctctgaggcctcctgtattcatcagtcggttttcatgctgctaataaagacattcttgagactgggtaatttataaaagaaagaggtttaatggactcaccgttccacatgtctgggaaggcctcacaatcatggcagaaggtgaacgaggggcaaagacacgtcttccatggtggtaggcaagagagcttgtgccgggggaactcccctttataaaaccatcagatctcgagagactgattcactaccatgagaacagcatgggtgaagcagccccatgattcagtcatctccacctggccccaaccttgacgcatggagattattacaattcaaggtgagatttgggtggtgacacagtcaaaccccatcccctccttcttcagctggtagatggcatcctctccctgcatcctcacaggtcttcccactgcgtgtgtctgtgtctaacctgccctttgcatattgcactaaggtccacgcatatgaccccaacttaactcagtcgcctcttggaagaccccatctccaaatacattctgaggtcctggggattaggatttccacagacagatttgaggagatgcgattcagcccataccaggtgttacatggttttaacccacccacaaaccctgcaagaccttcaagcttgactctccaggggtcgaaggggatgcatcttgccctaattcactcagccagaagtggccgggtcacctctcattccccagtgacacgttttccttccacgtccacagcagctgaaatgtcctggcagtaacctgaaagacagtgagtaaagggccctgggagccccgtggttcagtgtcgcccgggtgctgaggagaatgtgaggaaacccaggagaggttccctccactcaggacgggtgcagtagtgttgggctgttgttctaacacccaggggataattgggcgctgttccagtctctatcctaaagaacatggaaggaactcaacctcaagattcaagattccttaaagattcccccagccacctctgggacagcaaggacagggaggggaagggaggccctgctgttcctggaggcagctgtgtccctgccttccctggagttgcatcaattttccaataaatttcccctgctaccaacatgaattaggttgtatttcttctatttgcacccaagagagaacagtcgctgatgtaggcttttctcaggtaacgaaggtaagatgactgtgacatggtttctttccattgcacagccacggcctgtgtctttcagggtctcaaaaccctccagggagggggtagcggctggggccacccttacccagccttccagctccttagaagtacagcagagaggtggccaggtgcggtggctcacacctgtaatcccagcactttgggaggccacggtgggcagatcacctgaggtcacgagttcaagaccagcctggccaacatggtgaaaccctgtttttactaaaaatacaaaaattattcgggcatgttggtgggtgcctgtaatcccagctacttgggaggctgaggcaggaggatcacttaagcccaggaggtggaggttgcagtgagccgagatcctgccactgcactccaggctgggtgacacagcgagactccatctcaaacaaacaaacaaacaaacaataaagaagtgcagcatggaggtgtcctgagtcagagaccccgcagacccatcagtacagttttctccagcaggaggaagggctgccataagagtcgcaaccccacaatggaaggagccccttacaggtgggcggaatgggagctgtcagagcccaagggctcctgtcaccagctgctctccccttgttcgacctttgccctgtttggggctgaatggtgtctcctcctctccacattcctatgatgaagccctggcctccagcacctcagaaggtgactttacttggaaatagggccatgcaggtgtaattagctaagaagggtcatcctggaggaatgcatcccctaatctgactgctccttatgaaaagaataccctgtggagagaaaagggtgcatatggagggaagaccaagaacaagacacaggaaaaaggccatcgctaagccaaggggccaaagatggtcagcagcccaccagggagagaggcctggggccaattccccctcactgcctccaaaggagtcaacactgaggatcttgacctggtctcggacttccagcctccagaactgtggggctgtccatcctgttgtttaacctgctggtctgtggtgctttgtggctcccatgacaagctcccagcatcctctccctctcctggactggggttaggtctcttgtttgcaatccatctctctccaccacctgccctggggcactggaaggcagatggcacaggataaataggcatgggagggaaggggtgggatgctagtgggaaagaaagaattaggatgaatctatacaagagggaagtcaaaaggtggggacccaggctcagagcatctcagcaacagaagtcacaaaaatatcaaaaggagggtgaagaagctgggcttggtggctcacacctgtaatcccagcatttttggaggccgaggcaggtagatcacttgaggtcaggcgttcaagaccagcctgaccaacatggtgaaacctactaaaaatacaaaaattagctgggcatggtggcacaggcctgtagtcccagctactcaggaggctgaggcagagaatcgctagaacctgggaggtggaggctgaggtgagccgagatcatgacactgcactccagcccacgtgacagagtgagactccatctcaaaaaaaacaaaaacaaaacaaacaaaagaaaggtgaagagactccagaaggcaggtggcttagcaaactctcagctgccggtcttgtgcctctccgttccatggcctcagggtggggcagaggtaaattgcaatccctggacaggcttggatccacagtcgacccaacgtgaacacaggctgcgattccatggtctctggtgaccacatgtcctcctggtcccctccctgatggagcaccttgtatcctacctccactgcccactcgctctctcaggtccagccaagtcctctgacagaggtagtgtgacctagggagtctccggaatggcacaatctctcccagggggtgttcccatggtgcacagggcaaggttatccaagttccaagaaaacattctgtttgtggacctgacttaccggagcacatgagtgaaagcagataggaataagcagatcacggctcagctccgggtgcggggtggaaatcagggttaaccagagggcaatgggagaaaatgatgtggggcactcatttaaattatctgcaggactctgtatcatgaagataaacttattgcagccctagctcatgtttccagagcagagtcctgaggagaaggagcacttaccaaggacgaatgggtcactgcgtggtctgcaaatagcatctggaaaacaagaagctgggaccttggaaacagcaagagtcagagttggtcggggagcttgccctggacacagtgggcttcagtctagaagacaccgaaagacagagcgaactccctcctcctacaaactgttcacacagtgggaaggaggacggggtttagcaacacgctgtctcaaaaatgtgcactgtcaggcaaatatgtgcttgtaacaccagccctggagaggaaagtctctctgggcttcggtccctaacctttaccctaaacattaatatatcaatcggcagcggccctggagaagttgctgatggcatcagagaatgagggcattcactaagctgtcacagcagacccagatgcagtggcggaattaatttttccttcattaatcatatcctaatttgcatgattaatatgtcatagttgatgaacacgggcggatacaaataaaatcactgaacaaaaatgccacctgctgagcaaaaagaataagacaaacaagtgagttggcacagctaaatgagcaggagtcactttatttcccaaaaacaatattccaaaagcttgaaacaatgccactattggggccgcttgccgaggactgtggagacagacattcccagagttttccacggtgggatgagctccagggtacacacaactgtcacagcttgccattggacaattctaaaaactcacctttcgaacctcgcctgtttcccaagcggaacccaggccaaggggcgggatgttccaggacaaagtggtgccacctcgtcagcccaggcccacttcctccagctacgaacctcagccatttctggccagcggctctggggcagaaactggggcagggcattgccaaggacacaagcaaggggagcggaggaggagaggaagcagggagcgaccgtggaatggcctcggacctggggcagagccttcgggatgctggaagctgctcaggggccgtggctgaggcccaggcagccaccaggggggactccgactggggtccaggggcaggcaatgcccagcctccctggagcgtgggtttccttcaaggccacgtggcagaagcagccacaggagaagcagcgcagttttccgcagcggtgggaatgtcctagacctggcacatcccgacagtagtcactggcacacgtggcagtggaacacatgaatgtggccagggcggctgagaagcagacattttcatttcattttaattaatttaaattgaaaaacccacgtagggctagtggtccctggcgggcagctgaagggagtgtggggaccacagcacttccctggctgtgggacctggagaggtattcctcctttgcagctccgtcctcctctgaggctgaggggttggatgggggcatccctggagcccccagtctgcacttcctgactggagtgtggaaggcgcctgctctgtttgtttccactatccttccacaaccttcactgtctccctcccctctgcttaccgaaaactgcctcctgccagactaagttcctggcccctcactttccagccgcatcccccacgtctctaccacgtgaacagaccctcagccctcaaacacacctgtgcctcccacaccaccccgtaccttgtctgtgccattccccatggctcttccccacccactcaatactgatggagacccacctcaagcctgatgttctggaagcttcccagagctccatggcccacaggcttctcactcccccaccatttagaaggaacccagcctctggctgtggtagcttgcagggcagtcctctttatctcactgttacttgatagcaacaatgttgcaatgtcttggaaactgtgtaacaacctggcaaggctgagcacacctgcccacagagcggggaggtgcgcagcctgtcctcaacgccaactagcagggcggcctgaggaggtgactgcatctcctcatggtctcctcaccggaaacatgaggatcatgctgcttccttttggggttcatgtaagagccaggcgctcacctgtgccaaacgccctgcccgccctggcctgggttcagggttttcaatccatgctgtgctccctaaaagacaggccactcctctgctctccagcacctgaggaaacgttgttgctggttgcaggattccttagtctaatcctaacacctcagtggcttcatcctggcctcatgcattgtgctggagcctggtttctggtgcaggaaagttgtaagaatgcgttccctgccatctcgtttctattttgaactatctggcccaaacccttttctttagttttctcctcttcccttggggaaaaagaaaaggagaaaaaaggaaagaaaaggacaaaaaagaaatggagaagagaagcaagacagaggctgctctgaaatggtttctgcaccttctccaatacaaagggcagtaagattgagtaggatgagacagctatgacttcctattcccttttcccagcccccaggctaaaaaatatggtgggtctgaggttctactccccaaccccggccaacgctcaagcctagacaagagttggatgctccacgggagtaacgtgagacccaggaaggccacgtctcattttaacttcctctcctctattccataccacaatctccggggagcttcaatggatggagaaagttctatgcctgcaagaactgaatttaccatcagtgccttcatatttgtgataaccttgttttcccgttccttcagggatgctgcgctgagtgaagatcttcatgaataccgtgtgtgaggcaagtaaaagcggctccttgtggctcattcgctgcataaggtcccattcagagactcaaatccagaaactaaacatcattgaaaaggaatcctaacctctggtgctcctaaccaggagccgcatttctctaggacctctgccttggcctttccagcgccctgtgcccacagcggccctgcttgagccagtcataagcaaggcccccagctcctccccagccccgtccctctgggctcttctatttccccgcccagaggaaaacattcccagctatacagaagcagatgggatgggggttaccagggaggctccagagaaatggggagatgcaggtcaaggggagagagtcgcagtgaggtaggaggaatcagtccagaggctggctcgcaggaagatcgcagttcacagcactgcagcacaccccgggacttcaccaggagagtagattttagactctcttaccaccaaaatgatgaagaaaaagaagaagaagaggaagaggaagaggaagaagaagaagaagaagaagaaggggaaaggggaaggggaagggggagagggagggggaggggaagaagaaggggaagaggaggaagaagaggaagaagaggaggaggaggaggaggaggaccgggcggtgatggatttgagaacttgcctgactgtcttaatcaccatgtctatggatatcaacacagcaggtcataaatgttaaaaatcacgtccacccttaaacatatgcatttcttaaaaaggaaatgcgtcaccagccacatgtgtgagtcgaaattatctcatagacacatttgtaaaaagtaaaagaaggatgaaacttaatattatgctttaaccgagtacatccaaaatatcaatgaattacttataagatacattactttttttttctaagcagccttcgaaacgccgtgtgcctcttccacttgacagcatgtctccatttggactggccacattctcaaaagccgcaagtggctgaggactgccacggaggccacacagctccagtccattctactggttgttatgagttcagtgttagtgccgcccccaccccccaaaatttgcatgttgaagtcctaacccccagtgtgatgggcttggacatggggacgtcaggagataatcagggttcggtgcaatcctggtgatacaaccctcgtgctgggacgagtgccctcatgagaagaggccagaggacttgctctcctgccacgtaaggacacagtgagagggtggccgtctgcagcccaggaagaccctgacctgctggcaccccgatctcagactcccagcctccagaactgggggacatgactgtctgttgtggaaactcccagtctgtggtattttgccacggcagcctgagctaagacactggctttgcatggcgagagcctgcagatgatccagcaaaaacaaactgtccctagcaggcctggggcaagggggaggaccgagcagaccccatatccagcatcacagggttcgtgagtgagctgttatgcttggtgttgtgtgcagagattaaatgtccacagtctctgagttcacgaggcttatcatgtcatgagggacaagacgataactccggtttatgcctgcgttactactttacccactttctgtgcgcatggaaaatgacaggagagcacagaaaagcacccgtgtagcccagagatggacacaagtgctaaggaatccagatggaaatggaatgacttcggagtagggtagaaagaacctactgctactattatctactcttgaaaacctaaaaggttcgggggttttttttgaaaggcctctcccagcacagataggaattgtgtccatagtcaagggtcactccagcttctgatgctgcagctaatatgattggacttttgcccagattgtttcgaattgcccctgggccacatattaatttgtttcagatgctaccttttcccactgttagacataaaagaatcaaagtgaaaaaacaaagatgcaaagccctgggattgttaaaaagttaattgctcagtgttggcctaaatgacagaaaagtccccaacttcctcaaggtcagaattttacgtgtaaaaaaggaaaccttgagaatttagaaaacacttgcctcaaataagcatcattagccattgcaccagtggcttctacacaccaggttaagccacatcaaagaactcccacgctcctagacccagaaaaatagaagaaaataattaaacaaagtaattggaagcgcctggcaaggtcaaagtaccaggaaatgtccttgagtaaaaagaagcctgggactaagctgagcacatctaaaatctctcatatccaaagcctgtattttccttggcacgggagatggagaacttgatcctgaccattgacaaggaggccaggaggctaaatccgccacatgcaggcttcctcctaataccctgacgggacttccggcttctgtaaacttctgtgggaagtaggcacacgccgacttggggaaagttgaccagggtaagcctagaggagggacaatattataaactgtgtggaaggtcccctgagacgttcacagactcagagggaggagcggcagtgcggacttgaaagcaatccaggcggagctgccaagaggcttagccacaagcacggatccagccacagagctggggcgaggctgtgaggagcaagccgagccatggcatgccgctcggtggtgggggaatctggcggcactgtccaggaagagcccctctgcctccccggaaagctcccaccgatgatccactgagatgcacagacacgacccagaggccggctgggctgatcccacacgtggctggtggccaagggactcagccgtccacacccagccacacacaggaggctcgtcctatgagaccctcctaggatcctcgctcctgatgtgtcctcattcggcctgagcagtcgcggccatctcgcctcaggctgtccccatcttgcctcctacccacccccacggtctcccactggctcgagcccctgccctccccaggtcacttccaggtctgtctccatctggctgtgccactgtgctcccaaggcctccccagggagccgtccctgcaggggacatgtggcatggttttgctttgtagtcgtgatcttggagagagacactatgccctaatctcaaagacagtccctaaggctgtgaatgtcaggcccttaccaggcctggtggtagcaactatttcagagtaggcacattctttgggctccttccaaccacacgcatgagtaacactgggcctgcccagggtgaagatccagtggaagacatcatgtggatgaattcaagctggaaaataatcccaatgacatgaatatttcaacctaaactttgatttgtaccacaattatattttttctgattacaaaagtaatgcaatggcattgtaagggattaaagccttgttttatatgtatataatttttttttttttgagacggaggctcgctctgtcgcccaggctggagtacagaggcgcgatcttggctcactgcaagctccacctcctgggttcacgccattctcctgcctcagcctcccgagtagctgggactacaggcacccaccaccatgcccggctaatgttttgtattttcagtagagatggggtttcaccgtgttagccagggtggtctcaatctcctgaccttgcgatccacctgcctcggcctcccaaagtgctgggattacaggcgtgagccaccatgcccggcctatatgtatataatttttgtagacttgttctttcaatatacctccaggaagaaacacagcctaaatttacatgaatatgtttctggacttctttcttctcctcctcctcctcctcctcccctcctcctcctcctcccctcctcctcctcctccttccctcctcctcctccttccctcctcctcctccttccctcctcctcctccttccctcctcctcctcctcccctcctcctcctcctcccctcctcctcctccttcttcttcctcctcctctctctctctctgtctctctgtgtctctctctcttctctgtgtgtgtgtggatgtgtgtgtactcacacaacagagctctggagatgcatgcagcacacgcatatgtagatataaccactataaggacaatatcctaagagctgagtgtccaggtcactgattttcctttccttgtttcgttgcaaactcagggtgtcacacctgggccgtgtggaggctgagggatgggtgaggacagatggggatgggcaccctgctgttgtctgagggccgtcagcaagtctctcaattggtgatacgtatggacctgggtcctcatgagagccatcctaatcttttctcagtgatgcaacaccgtctgtttccatgccatcagtcttattacaggatgatggccaaggagctcatctgaactgccaggtgaacagtggggccctaccacatccccatctacccatagcttggtttgggttcacggtgccaaaatcatatccccaagttatagtataggctcattgccaagggagttttcttgtaaacactccctggccctgggaacccttctctgacctaaaggaggcatcgctggactaggttccgggtaatgcaatcacctagtgacccgtgtccccagcctgttctcaggtcctttgcattttcctcaatgtccttcctgctcatgccctcaggcccctgcttttgggatgtgtggccagcaagcccagtgcaggaagtactgagctgccgactgccactccacagaatcacaggacagagcctcccagaggcagtaagtgcagcgtgggctggaggaggccacctgctccgttgtgatgagggctggcctctgctgtgctttgatttatgagcaatcatgtgttcacaaagtacctactactatgtgaccagtgcagcagccagcagggtctgcataacagtggctgcaagctctccacccagactcctgccctcgtccatggggatgaggttggggcagcctccatgcagttagcacctccttccactctccccctccagccagcaggagccacagtgggccacaaggaggactctgccctgaaagtggcagatcccagcccaggagaacctgggtccctggacggcagcctgggcctgcacccctgacccgggccggcccccaggagctgtcttgtcagcgagcagcacccacgttttcaggtttcagcagcttagctttatcctgaccgatgcttggcactcaggacacgcatctgctatccctgctctccactcccctaaatcttgaggaccggtgtcctctcggttatagcctaaactacaagtgtcatcatcgtctctgtgcgtcggtggtcaggaagtttgattgtagaatatcaggatgaaacctttccgccagcctcgttttccctggacgtgatgtctggagtcagagttaacaagtctcctgcttcctggctggaggctgcggtctttattcctcagaagggggcccagaccgttccactgttgacattgtgtcttcgcagacggctcagtggctccttcaggctgtgccctgctgtgaatctcagcctcgactccagcctggtgcaggggtgcagggcacagagcacacgccacacagtcaccgcaggccctgaacccagtggaacctgccctgtggggctggggtgttgcttaggacccgagacagcgtcttccctccagtttctcccctttggaaggggactggctttcttctgcctgtcccaccatggcatttgggaagcagataacctgttttccagacagaagatgccacaccctgtgaagacatagactctcagggagaagaccccagaggacagaggcagggctgggggtgacatgtccacagccaaggaacaccaaagacaccaagccaccatagtatgccagtagagaggcctggaacagactctccctcccaccctcggagggagcctgccctgccgacaccttgacttcaaacttccggcttccaggatgacgagagcatcagttgccctcactttaaggtctcaagttctgtacattctgcacattcccagaaaaggttggtcacagcagcctacagtatttcagtttagcgtattcttctgtgttcagtgcatattcccaacacggtctagaacgccctttacttcacaagcacaattccatagtaaaacttaataatggtgctctgggccaggccatttgatctggctggactgtgttccctggctgtgccctgaatgtgtcacctgcagccacacagggcgccctctcattcttgcactgacccagctcctaaacagcagctttccagcagtggttcctggacttccagagagcttttctgccacagtggacattgccatcctttttttggccaccaggcatctgaaatccttcccagtgtttggtgaatcctccaactcgtgacacaggatctgaacgtagctacactacattcagaaagtgcagaggccagcactcgctttgcccacaggggcactcgcacccatgagcctagctgcaagcctaccctgccgggaagctagtgactcccagaactcagacggctcagacaccaccctggatggccacgccgttcccatgggcagaggtgtcagcaggtctagcggcagcctgcagcctctagcctgaggtcccttctgtgtgtgcagccagtagtgctggtggtagagacttccctgagcgggtcccagtgtcctttttcccagcatctttctcgctgtggtaggctaggaaactcgttctcctccccacgccacctccattccttgagctagacaatatataattcttttaataatcgctttaataatttaaaggaatatttaaatactcttttaacaattccttttctgcttcagttacccagagctgtgttctgccacctcccactgagaaccgtaagtggttctttcctccgtaagcacatactcctgtttgacatgaaaatgtcagcagagatttttcggcgtgatctaaagaatgcgatcttggcggccgtctaccacacaaggaggagggcacgtgtggatttcctggccttgcacagttggtgatgaaagcggagttgcctagtgatcagctgacttgtgatcaattacaataatgatggaatttcaaggtcaatgtcgtgctggtttttttttttttgcgagctcatcttttctgcttaaggagaaaatgctagataaatgcatctccatgtgggcctggacctctccatgttgctctgtcttgtctgtggatgtttgacagagaccggaagacctgcagaccagcctgccaacaccgtctgtcaatggggtgccactttcacggccctccccttcccatcagccttagcccaaatcaccctccaaaatcaccaaccataggaaacatctttaatgtaaactaattccttcacactgaaaatgtttacaatttagctgggtgcggtggctcacacctctaatcccagcactttgggaggctgaggcgggcagaaggcttgaggtcaggagttcaaaaccagtctgagcaacatgacgaaaccctgtctccacaaaaaatttaaaaaattagctgaacatggtggcacatgcctctggtcacagctacttgggaggctgaggtgggtggattgcttgaagctgggaagttgaaactgcagtgagccaagattgcaccactgcactccagcctgggcagcagagaaggaccctgtctcaaaacaaacaaacaaaaaccaaaaatgaaataaaatgcttactgtcggccccctttctctgcagaggtccagatgaggagcctctaatcaaggtggtgactgggccacacagccacgcccttccctcggggtgagcccttccctaggggtgagcccttccctggggtgagcccttccctcggggtgaatctttcccttggggtgcacccttccctcggggtgagcacttccctctgggtgcagcctttgctcggggtgagcccttccctcgggttgagcccttaccacagggtgcgcccttccctaggggtgagcccttccctcggggtgaaactttcccttggggtgcgcccttccctcagggtgagcacttccctctgggtgcagctttggggtgaacccttccctcggggtgcagccttcactcaagggtgagcccttccctgggggtgcagccttcgctggagggtgcatcctcccctcggggtgcgccgtggcacatgttgcctctccactcactgctctttcttggctgcctccttcctggtgagtcctttcccgctgttgctcactatctgcggatttctgatcacttgtcttccctcttgagcttggtgaacagaccaggaggagggcacaggatgacccccatggctccccgaacatttctaagaccaaaaccaaaaagcccaaggggagaggaccggaccccactcagggctcagaaagctgatgcctggcgccccgcagtggcgtggggtggtcttgcgtggctgtggacccctcaaccaggcaggcgagagcagggagggaagtgggtacaagtgagcaagtgtgtgagtgtgtgggagtatgactgttagtgtgtgtgtgtctgagtgtatgtgtgactgtgtatgtgtgtctgagtgttagtgtgtgtgtgagtgcgtgggagtttgtgtgtctgagtgtaagtatgtgtgtctgagtatatgtgactgcgtatgtgtgtctgagtgttagtgtgagtgtgtgtgtctgcgtgttcgcgtgtgtctgagtgtatgtgtatgtgtctgagtatgtgtgactgtgtatgtgtgtctgagagttagtgtgtgtgtgtctgcatttagtgtgtgagtgtgtgtctgagggttagtgtgtgtgtctcagtgttagtgtgtgggagtgtgtgtgagtgtgagtgggtgtctgagtgttagtatgtgtctgagtgttagtgtgggagtatgtctgagtgtgtgtatctgttagtgtgtgagcgtatgagtgtgagtgtgtgcatgctgggaagagacatgggctaagaataaaacactttcccagagtgtagcaaataatagcaaagttcacccatcagttctcctgccttaagcaactatgggctttcactcttcaactttcttctctctctctctctctcacacacacacacacacacacaccatgagacctcttctgagctctcctggcaaggttgggctccctgctgcccccatatcccctcacttacaccaagttccgtccccctgactggaatgtttggggtgagagcccctcctttgtcctatttgcaccagcgtcagctgaacgtgttaggaagtgtgaccgccgcctctcatggaccccagaacaacctcctgttcgcacaggggcccactcctaatcttctggagttggcatcatgggagatgaccaaactctcctgaaaagtcttgcgcagtaccatgatcaataaaactaggagagtataacagaacgctctgaatttggagccagaaaaccttgattcaggtccttcatgtggccttgggcaaatcacttaacctttctgagcctgtaccctcaaccgtatcttcctgtttcttaagatcaatgtgaggtttaatgataaataactcttaaaagggctttgcatcatgcttgggcattttggctattcaagaacctcgcgctgcatgaagaaagatgcattctgtgtgactctggaggcttttcgagcagagagaaacagcaggttcacaggtaagaaccaggaaggccatgtgggctgggaagatggtgaggcagctttgaatgcagcagtggtgtgggggcacagggtagggggaggttagatatgcaactgacttcagagtttccttctcagcttccctggatgggagttagtgttaggatcataagtcagaatacaattgggatcgtagaaatttcccaattctagtcactctgtgctcaggtacaactacttaagcacgatcattgtctcggtccaggacacatccattcacacatgcacacacacacgccatgtgtgcacacataggtatatacaagcattacatgcacacacccccacatgtatatacacatatagacacacatgcacacacccacatgtgcatgcacacacccataaacaggcacacacgtgtgagcacaggcataaacatgcatacacttacgcacacacatgcatacatgccccttaaactcactgcagagtctgaagagaggttgttgacttgaggagcagcactgtgcgtttaaatgaggcaaaagaaagttgaccacccccagcctgaccaggagttgtggttggccaggaaaataatatttggagctcatgaataaagaagtcatgatgactgagatgggggcactcgtctccacccaaggcacctgccaggcagttgcatcactacctcgcccctgtgccccagggctgtgagccctcctggctgccagcagtgcctgaactcagaaccaacaggaccttggggcacagctccgtggccctttcagtgaccgccctcttcttcctcttgcagccctcggcttgttcctcctcctgctcacacttcacccttcaccctggctgacctgcgtgtgccaaacacggttgtgagctcccacagaacgaggagaggcagcccgttccgctgcatctccccagggcaccggcaaggacaggcaaagcctcgttgactgaattcacggagagcagagactgcgcccaggcctcgaccccaggacttctgtgttgtgtgagacgtgctagtgatgccgctttaagctctgctttgaaaatggtcctttgacagattctgaatgcaagtggcctccttacgagatcctgcagaataacaaggacaacttatcacaacttcctcattgtaaaatccagctcagattgcagttgaagatcacaaatgctctctgtttcactttgcgatgtttgtggtgtctaatacagcaacacaagcctaggtttctgtgcaaagacttccttattgtttatttactatccacttcctctgagcaggactgatcgacttttcacttcttaggcccctggtgggtggcctaacattgggaacgtctctgggaatcaatggcctcccatgctattgccctaagaggaaaaactatggacccatttccggctcgtgagttggaagtggaggtctgctggcggcctttgtctccctgccttcccctcctgtcactggctggaacatgtgcttgatgcctggcgttcagcagccctgttgaaactgtgaggtgactggcaggtgtcagaaggaaagcaaactgcctagtgacggcagaggctgcatgcactccactgccctctgctccactgtccactcacctccgctggctctgtgccccaaggccctggcctctatggccggcatccatgggcttccctatcctctggcctccaggtggattcagtcacagcagaagctgggaggggcagctggaggttggagaaacatgaggctagtgtccagttccctccctggccgaggcagccgtggaggtgctcctttccaggaagccagcactcctttccggtggtcctgctctgaccacggcagctcgagctgagcacagagtgacggctacagctccctccacatctggcctggggtgggaacagctcctggatgcttcttcttcctgtgctggcatcccttagtccctcccacctttttttttttaatataataaacctgctttgttcaatcctcctcaaccacccactgaagcaagccctcctttccttgccgggacccagagagctgctgggaaagaaagggtgggccccccgcagtgtggtcagcacctgggcagaccccacccaccttctatgatgaaagccctggatggattcctatccccaccctgagctcctcccctaactccccaaaacattgggaagatgggccttctgtcctggaagggccagtctcctgggcagagcgc
